US011149286B1

(12) United States Patent
Barry

(10) Patent No.: US 11,149,286 B1
(45) Date of Patent: Oct. 19, 2021

(54) ADENOVIRUS VECTORS AND METHODS FOR USING ADENOVIRUS VECTORS

(71) Applicant: Mayo Foundation for Medical Education and Research, Rochester, MN (US)

(72) Inventor: Michael A. Barry, Rochester, MN (US)

(73) Assignee: Mayo Foundation for Medical Education and Research, Rochester, MN (US)

(*) Notice: Subject to any disclaimer, the term of this patent is extended or adjusted under 35 U.S.C. 154(b) by 0 days.

(21) Appl. No.: 16/996,740

(22) Filed: Aug. 18, 2020

Related U.S. Application Data

(60) Provisional application No. 63/066,740, filed on Aug. 17, 2020.

(51) Int. Cl.
| | | |
|---|---|---|
| A61K 39/00 | (2006.01) | |
| C07K 16/10 | (2006.01) | |
| A61K 45/06 | (2006.01) | |
| A61K 39/42 | (2006.01) | |
| A61K 39/12 | (2006.01) | |
| C12N 15/86 | (2006.01) | |
| C12N 7/00 | (2006.01) | |
| C07K 14/005 | (2006.01) | |
| A61P 31/04 | (2006.01) | |
| A61P 37/04 | (2006.01) | |
| A61P 31/14 | (2006.01) | |
| A61K 9/00 | (2006.01) | |
| A61K 39/08 | (2006.01) | |

(52) U.S. Cl.
CPC .......... *C12N 15/86* (2013.01); *A61K 9/006* (2013.01); *A61K 39/08* (2013.01); *A61K 39/12* (2013.01); *A61P 31/04* (2018.01); *A61P 31/14* (2018.01); *A61P 37/04* (2018.01); *C07K 14/005* (2013.01); *C12N 7/00* (2013.01); *A61K 2039/5256* (2013.01); *A61K 2039/541* (2013.01); *C07K 2319/33* (2013.01); *C12N 2750/14122* (2013.01); *C12N 2750/14143* (2013.01); *C12N 2770/20022* (2013.01)

(58) Field of Classification Search
CPC .......... C07K 2317/565; C07K 2317/76; C07K 2317/92; A61K 45/06; A61K 39/42
See application file for complete search history.

(56) References Cited

U.S. PATENT DOCUMENTS

| | | |
|---|---|---|
| 6,569,677 B1 | 5/2003 | Legrand et al. |
| 10,131,921 B2 | 11/2018 | Barry et al. |
| 2006/0062764 A1 | 3/2006 | Police et al. |
| 2019/0093127 A1 | 3/2019 | Barry et al. |
| 2020/0002725 A1 | 1/2020 | Barry et al. |
| 2020/0255865 A1 | 8/2020 | Barry et al. |

FOREIGN PATENT DOCUMENTS

| | | | |
|---|---|---|---|
| CN | 111560076 | * | 8/2020 |
| WO | WO 2009/111738 | | 9/2009 |

OTHER PUBLICATIONS

Graham et al., "Evaluation of the immunogenicity of prime-boost vaccination with the replication-deficient viral vectored COVID-19 vaccine candidate ChAdOx1 nCoV-19", NPJ Vaccine, 2020, 69:1-6.*
Aboudola et al., "Clostridium difficile vaccine and serum immunoglobulin G antibody response to toxin A," Infec. Immunity, Mar. 2003, 71(3):1608-1610.
Aktories et al., "Clostridium difficile toxin biology," Annu. Rev. Microbiology, Sep. 2017, 71:281-307.
Anguiano-Zarate et al., "A replicating single-cycle adenovirus vaccine against Ebola virus," J. Infect. Diseases, Nov. 2018, 218(12):1883-1889.
Anosova et al., "Systemic antibody responses induced by a two-component Clostridium difficile toxoid vaccine protect against C. difficile-associated disease in hamsters," J. Med. Microbiology, Sep. 2013, 62(9):1394-1404.
Babcock et al., "Human monoclonal antibodies directed against toxins A and B prevent Clostridium difficile-induced mortality in hamsters," Infec. Immunity, Nov. 2006, 74(11):6339-6347.
Baliban et al., "An optimized, synthetic DNA vaccine encoding the toxin A and toxin B receptor binding domains of Clostridium difficile induces protective antibody responses in vivo," Infec. Immunity, Oct. 2014, 82(10):4080-4091.
Barefoot et al., "Comparison of multiple vaccine vectors in a single heterologous prime-boost trial," Vaccine, Nov. 2008, 26(48):6108-6118.
Barouch et al., "Control of viremia and prevention of clinical AIDS in rhesus monkeys by cytokine-augmented DNA vaccination," Science, 2000, 290:486-492.
Barry and Johnston, "Biological features of genetic immunization," Vaccine, 1997, 15:788-791.
Barry et al., "Expression Library Immunization to Discover and Improve Vaccine Antigens," Immunological Reviews, 2004, 199:68-83.
Barry et al., "Production of monoclonal antibodies by genetic immunization," Biotechniques, 1994, 16:616-619.
Barry et al., "Protection against mycoplasma infection using expression library immunization: A general approach to vaccine development," Nature, 1995, 377:632-635.
Barry et al., "Role of endogenous endonucleases and tissue site in transfection and CpG-mediated immune activation after naked DNA injection," Human Gene Therapy, 1999, 10:2461-2480.
Basnight et al., "Characterization of four new adenovirus serotypes isolated from chimpanzee tissue explants," Am J Epidemiol., 1971, 94:166-171.

(Continued)

*Primary Examiner* — Barry A Chestnut
(74) *Attorney, Agent, or Firm* — Fish & Richardson P.C.

(57) ABSTRACT

This document provides adenovirus vectors and methods and materials related to using adenovirus vectors. For example, adenoviruses for delivering nucleic acid encoding one or more immunogens (e.g., one or more immunogens associated with a pathogen causing an infection) to cells within a mammal such that the mammal produces an effective immune response against the immunogen(s) are provided.

19 Claims, 202 Drawing Sheets
Specification includes a Sequence Listing.

(56) References Cited

OTHER PUBLICATIONS

Benson et al., "Recombinant vaccine-induced protection against the highly pathogenic simian immunodeficiency virus SIVmac251: dependence on route of challenge exposure," J. Virol., 1998, 72:4170-4182.
Bergelson et al., "Isolation of a common receptor for Coxsackie B viruses and adenoviruses 2 and 5," Science, 1997, 275:1320-1323.
Brayden, "Oral vaccination in man using antigens in particles: current status," Eur J Pharm Sci., 14:183-189.
Buge et al., "Factors Associated with Slow Disease Progression in Macaques Immunized with an Adenovirus-Simian Immunodeficiency Virus (SIV) Envelope Priming-gp120 Boosting Regimen and Challenged Vaginally with SIVmac251," J Virol., 1999, 73:7430-7440.
Buge et al., "An adenovirus-simian immunodeficiency virus env vaccine elicits humoral, cellular, and mucosal immune responses in rhesus macaques and decreases viral burden following vaginal challenge," J. Virol., 1997, 71:8531-8541.
Campos and Barry, "Comparison of adenovirus fiber, protein IX, and hexon capsomeres as scaffolds for vector purification and cell targeting," Virology, 2006, 349:453-462.
Campos and Barry, "Current advances and future challenges in Adenoviral vector biology and targeting," Curr Gene Ther., 2007, 7:189-204.
Campos and Barry, "Rapid construction of capsid-modified adenoviral vectors through bacteriophage lambda Red recombination," Hum Gene Ther., 2004, 15:1125-1130.
Carter et al., "The role of toxin A and toxin B in Clostridium difficile-associated disease: Past and present perspectives," Gut Microbes, Jan. 2010, 1(1):58-64.
Casimiro et al., "Comparative immunogenicity in rhesus monkeys of DNA plasmid, recombinant vaccinia virus, and replication-defective adenoviral vectors expressing a human immunodeficiency virus type 1 gag gene," J. Virol., 2003, 77:6305-6313.
Casimiro et al., "Vaccine-induced immunity in baboons by using DNA and replication-incompetent adenovirus type 5 vectors expressing a human immunodeficiency virus type 1 gag gene," J Virol., 2003, 77:7663-7668.
Caulfield et al., "Sustained Peptide-Specific Gamma Interferon T-Cell Response in Rhesus Macaques Immunized with Human Immunodeficiency Virus gag DNA Vaccines," J Virol., 2002, 76:10038-10043.
Chai et al., "Management of primary and recurrent Clostridium difficile infection: an update," Antibiotics, Sep. 2018, 7(3):54, 8 pages.
Cheng et al., "PEGylated adenoviruses for gene delivery to the intestinal epithelium by the oral route," Pharm Res., 2003, 20:1444-1451.
Couch et al., "Immunization with types 4 and 7 adenovirus by selective infection of the intestinal tract," Am Rev Respir Dis., 1963, 88:SUPPL 394-403.
Crosby et al., "Amplified and persistent immune responses generated by single-cycle replicating adenovirus vaccines," J. Virology, Jan. 2015, 89(1):669-675.
Crosby et al., "IIIa deleted adenovirus as a single-cycle genome replicating vector," Virol. Journal, Aug. 2014, 462:158-165.
Crosby et al., "Replicating single-cycle adenovirus vectors generate amplified influenza vaccine responses," J. Virology, Jan. 2017, 91(2):e00720-16, 12 pages.
Crosby et al., "Transgene expression and host cell responses to replication-defective, single-cycle, and replication-competent adenovirus vectors," Genes, Feb. 2017, 8(2):79, 14 pages.
Crotty et al., "Protection against simian immunodeficiency virus vaginal challenge by using Sabin poliovirus vectors," J Virol., 2001, 75:7435-7452.
Croyle et al., "Nasal delivery of an adenovirus-based vaccine bypasses pre-existing immunity to the vaccine earner and improves the immune response in mice," PLoS One, Oct. 2008, 3(10):e3548, 9 pages.

Croyle et al., "'Stealth' adenoviruses blunt cell-mediated and humoral immune responses against the virus and allow for significant gene expression upon readministration in the lung," J Virol., 2001, 75:4792-4801.
Croyle et al., "Development of a rapid method for the PEGylation of adenoviruses with enhanced transduction and improved stability under harsh storage conditions," Hum Gene Ther., 2000, 11:1713-1722.
Croyle et al., "Development of formulations that enhance physical stability of viral vectors for gene therapy," Gene Ther., 2001, 8:1281-1290.
Croyle et al., "PEGylation of El-deleted adenovirus vectors allows significant gene expression on readministration to liver," Hum Gene Ther., 2002, 13:1887-1900.
Dale et al., "Chimeric human papilloma virus-simian/human immunodeficiency virus virus-like-particle vaccines: immunogenicity and protective efficacy in macaques," Virology, 2002, 301:176-187.
D'ambrosio et al., "Neutralizing antibodies against 33 human adenoviruses in normal children in Rome," Epidemiol. Infection, Aug. 1982, 89(1):155-161.
Daniel et al., "Protective effects of a live attenuated SIV vaccine with a deletion of the nef gene," Science, 1992, 258:1938-1941.
Davis and Matyjaszewski, "Atom transfer radical polymerization of tert-butyl acrylate and preparation of block copolymers," Macromolecules, 2000, 33:4039.
Demberg et al., "A replication-competent adenovirus-human immunodeficiency virus (Ad-HIV) tat and Ad-HIV env priming/Tat and envelope protein boosting regimen elicits enhanced protective efficacy against simian/human immunodeficiency virus SHIV89.6P challenge in rhesus macaques," J Viro., 2007, 81:3414-3427.
DePestel et al., "Epidemiology of Clostridium difficile infection," J. Pharm. Practice, Oct. 2013, 26(5):464-475.
Donald et al., "A novel approach to generate a recombinant toxoid vaccine against Clostridium difficile," Microbiology, Jul. 2013, 159(7):1254-1266.
Duncan et al., "Infection of mouse liver by human adenovirus type 5," J Gen Virol., 1978, 40:45-61.
Duraiswamy et al., "Induction of Therapeutic T-Cell Responses to Subdominant Tumor-associated Viral Oncogene after Immunization with Replication-incompetent Polyepitope Adenovirus Vaccine," Cancer Research, 2004, 64:1483-1489.
Fausther-Bovendo et al., "Pre-existing immunity against Ad vectors: humoral, cellular, and innate response, what's important?" Hum. Vaccin. Immunotherapeutics, Oct. 2014, 10(10):2875-2884.
Fields et al., "Role of vector in activation of T cell subsets in immune responses against the secreted transgene product factor IX," Molecular Therapy, 2000, 1:225-235.
Fischinger et al., "Sex differences in vaccine-induced humoral immunity," Semin. Immunopathology, Mar. 2019, 41(2):239-249.
Fisher et al., "Polymer-coated adenovirus permits efficient retargeting and evades neutralising antibodies," Gene Ther., 2001, 8:341-348.
Frey et al., "A statistically defined endpoint titer determination method for immunoassays," J. Immunol. Methods, Dec. 1998, 221(1-2):35-41.
Frey et al., "Localization of two epitopes recognized by monoclonal antibody PCG-4 on Clostridium difficile toxin A," Infect. Immunity, Jun. 1992, 60(6):2488-2492.
Gardiner et al., "A DNA vaccine targeting the receptor-binding domain of Clostridium difficile toxin A," Vaccine, Jun. 2009, 27(27):3598-3604.
GenBank Accession No. AA024897, gi No. 1489803, dated Jan. 1, 2011, 2 pages.
GenBank Accession No. AAA03229.1, "MAGE-1 [*Homo sapiens*]," dated Jun. 23, 2010, 1 page.
GenBank Accession No. AAD33253.1, "E7 [Human papillomavirus type 16]," dated Jul. 26, 2016, 1 page.
GenBank Accession No. AAD56719.1, "allergen [*Arachis hypogaea*]," dated May 10, 2010, 1 page.
GenBank Accession No. AB353125, dated Mar. 5, 2008, 13 pages.
GenBank Accession No. AF030154, dated Oct. 20, 2000, 13 pages.
GenBank Accession No. AF268967, dated Jul. 31, 2000, 2 pages.

(56) References Cited

OTHER PUBLICATIONS

GenBank Accession No. AY772062.1, "SARS coronavirus WH20, complete genome," dated Mar. 25, 2009, 10 pages.
GenBank Accession No. BC109215, dated Aug. 7, 2008, 2 pages.
GenBank Accession No. CAA30155, gi No. 4582, dated Jun. 12, 2006, 2 pages.
GenBank Accession No. CEQ32409.1, "LMP-1 [Human gammaherpesvirus 4]," dated Sep. 24, 2015, 1 page.
GenBank Accession No. D55656S08, gi No. 951475, dated Dec. 26, 2002, 3 pages.
GenBank Accession No. DQ227321, dated Jun. 1, 2007, 6 pages.
GenBank Accession No. DQ437592, dated Aug. 19, 2006, 79 pages.
GenBank Accession No. EU497921, dated Dec. 22, 2008, 2 pages.
GenBank Accession No. K02718, dated Mar. 18, 1994, 4 pages.
GenBank Accession No. L12723, dated Sep. 8, 1993, 2 pages.
GenBank Accession No. M73260, dated Apr. 8, 1996, 10 pages.
GenBank Accession No. M92650, dated Nov. 7, 1994, 2 pages.
GenBank Accession No. MN938384, "Wuhan seafood market pneumonia virus isolate 2019-nCoV_HKU-SZ-002a_2020, complete genome," dated Jan. 24, 2020, 10 pages.
GenBank Accession No. NC_001798, dated Apr. 23, 2010, 65 pages.
GenBank Accession No. NC_001802, datsed Dec. 8, 2008, 8 pages.
GenBank Accession No. NC_004102, dated Jun. 18, 2009, 6 pages.
GenBank Accession No. NM_000282, dated Mar. 31, 2012, 5 pages.
GenBank Accession No. NM_000453, dated Apr. 1, 2012, 6 pages.
GenBank Accession No. NM_004988, dated Apr. 22, 2012, 4 pages.
GenBank Accession No. NP_001003190.1, "major allergen Can f 1 precursor [Canis lupus familiaris]," dated Jul. 23, 2019.
GenBank Accession No. NP_001191706.1, "Fel d 7 allergen precursor [Felis catus]," dated Mar. 1, 2018, 1 page.
GenBank Accession No. NP_001363134.1, "profilin [Arachis hypogaea]," dated Nov. 11, 2019, 2 pages.
GenBank Accession No. NP_001363136.1, "allergen Ara h 1, clone P17 precursor [Arachis hypogaea]," dated Nov. 11, 2019, 2 pages.
GenBank Accession No. NP_001363139.1, "allergen Ara h 1, clone P41B precursor [Arachis hypogaea]," dated Nov. 12, 2019, 2 pages.
GenBank Accession No. P10414.2, "RecName: Full=Pollen allergen Amb t 5; AltName: Full=Allergen Amb t V; AltName: Full=Allergen Ra5G: AltName: Allergen=Amb t 5; Flags: Precursor," dated May 23, 2018, 2 pages.
GenBank Accession No. P15494.2, "RecName: Full=Major pollen allergen Bet v 1-A; AltName: Full=Allergen Bet v I-A; AltName: Allergen=Bet v 1-A," dated Jul. 3, 2019, 4 pages.
GenBank Accession No. P27762.1, "RecName: Full=Pectate lyase 4; AltName: Full=Antigen Amb a II; AltName: Full=Antigen K; Short=AgK; AltName: Full=Pollen allergen Amb a 2; AltName: Allergen=Amb a 2; Flags: Precursor," dated Dec. 5, 2018, 2 pages.
GenBank Accession No. P43176.2, "RecName: Full=Major pollen allergen Bet v 1-C; AltName: Full=Allergen Bet v I-C; AltName: Allergen=Bet v 1-C," dated Jul. 3, 2019, 2 pages.
GenBank Accession No. Q02496.2, "RecName: Full=Mucin-1; Short=MUC-1; AltName: Full=Episialin; AltName: CD_antigen= CD227; Contains: RecName: Full=Mucin-1 subunit alpha; Short= MUC1-NT; Short=MUC1-alpha; Contains: RecName: Full= Mucin-1 subunit beta; Short=MUC1-beta; AltName: Full=MUC1-CT; Flags: Precursor," dated Feb. 13, 2019, 6 pages.
GenBank Accession No. QAR15051.1, "EBNA-1 [Human gammaherpesvirus 4]," dated Jan. 18, 2019, 1 page.
GenBank Accession No. X02777, gi No. 3308, dated Oct. 23, 2008, 2 pages.
GenBank Accession No. X15980, gi No. 7157, dated Mar. 31, 1995, 2 pages.
GenBank Accession No. X17016, Apr. 18, 2005, 2 pages.
GenBank Accession No. X17329, gi No. 1756, Oct. 21, 2008, 2 pages.
GenBank Accession No. X51613, gi No. 5095, dated Nov. 14, 2006, 2 pages.
GenBank Accession No. X65470, gi No. 4100, dated Apr. 18, 2005, 2 pages.
GenBank Accession No. XP 001657779.1. "37 kDa salivary gland allergen Aed a 2 [Aedes aegypti]," dated Jul. 20, 2017, 1 page.
GenBank Accession No. XP_002754883.1, "folate receptor alpha [Callithrix jacchus]," dated Aug. 31, 2016, 1 page.
GenBank Accession No. XP_030099003.1, "major allergen I polypeptide chain 1 [Mus musculus]," dated Aug. 8, 2019, 1 page.
GenBank Accession No. YP_401631.1, "membrane protein LMP-2A [Human gammaherpesvirus 4]," dated Aug. 13, 2018, 2 pages.
GenBank Accession No. YP_401632.1, "membrane protein LMP-2B [Human gammaherpesvirus 4]," dated Aug. 13, 2018, 2 pages.
GenBank Accession No. Z14860, gi No. 6528, dated Jan. 25, 2011, 2 pages.
GenBank Accession No. Z17325, dated Dec. 3, 1992, 1 page.
Gomez-Roman et al., "An adenovirus-based HIV subtype B prime/boost vaccine regimen elicits antibodies mediating broad antibody-dependent cellular cytotoxicity against non-subtype B HIV strains," J Acquir Immune Defic Syndr, 2006, 43:270-277.
Gomez-Roman et al., "Oral delivery of replication-competent adenovirus vectors is well tolerated by SIV- and SHIV-infected rhesus macaques," Vaccine, 2006, 24:5064-5072.
Gould-Fogerite et al., "Targeting immune response induction with cochleate and liposome-based vaccines," Adv Drug Deliv Rev., 1998, 32:273-287.
Greco et al., "Carbohydrate recognition by Clostridium difficile toxin A," Nat. Struct. Mol. Biology, May 2006, 13(5):460-461.
Greenwald et al., "Drug delivery systems employing 1,4- or 1,6-elimination: polyl(ethylene glycol) prodrugs of amine-containing compounds," J Med Chem., 1999, 42:3657-3667.
Henderson et al., "A review of the safety and efficacy of vaccines as prophylaxis for Clostridium difficile infections," Vaccines, Sep. 2017, 5(3):25, 9 pages.
Hofherr et al., "Polyethylene Glycol Modification of Adenovirus Reduces Platelet Activation, Endothelial Cell Activation, and Thrombocytopenia," Human Gene Therapy, 2007, 18:837-848.
Howell et al., "Deoxyribonuclease II is a lysosomal barrier to transfection," Mol Ther., 2003, 8:957-963.
Huang et al., "Adenovirus interaction with distinct integrins mediates separate events in cell entry and gene delivery to hematopoietic cells," J. Virol., 1996, 70:4502-4508.
Hutton et al., "Small animal models for the study of Clostridium difficile disease pathogenesis," FEMS Microbiol. Letters, Mar. 2014, 352(2):140-149.
Igarashi et al., "Protection of monkeys vaccinated with vpr- and/or nef-defective simian immunodeficiency virus strain mac/human immunodeficiency virus type 1 chimeric viruses: a potential candidate live-attenuated human AIDS vaccine," Journal of General Virology, 1997, 78:985-989.
Ji, "Lysis of cultured cells for immunoprecipitation," Cold Spring Harb. Protocols, Aug. 2010, 2010(8):pdb-rot5466, 5 pages.
Jin et al., "Immunization with adenoviral vectors carrying recombinant IL-12 and E7 enhanced the antitumor immunity to human papillomavirus 16-associated tumor," Gynecologic Oncology, 2005, 97:559-567.
Johnston and Barry, "Genetic to genomic vaccination," Vaccine, 1997, 15:808-809.
Kaneko et al., "Oral DNA vaccination promotes mucosal and systemic immune responses to HIV envelope glycoprotein," Virology, 2000, 267:8-16.
Kaplan et al., "Induction of Antitumor Immunity with Dendritic Cells Transduced with Adenovirus Vector-Encoding Endogenous Tumor-Associated Antigens," Journal of Immunology, 1999, 163:699-707.
Kelly et al., "Clostridium difficile—more difficult than ever," N. Engl. J. Medicine, Oct. 2008, 359(18):1932-1940.
Kim et al., "Immunization of adult hamsters against Clostridium difficile-associated ileocecitis and transfer of protection to infant hamsters," Infect. Immunity, Dec. 1987, 55(12):2984-2992.
Kink et al., "Antibodies to recombinant Clostridium difficile toxins A and B are an effective treatment and prevent relapse of C. difficile-associated disease in a hamster model of infection," Infect. Immunity, May 1998, 66(5):2018-2025.

(56) References Cited

OTHER PUBLICATIONS

Kuehne et al., "Importance of toxin A, toxin B, and CDT in virulence of an epidemic Clostridium difficile strain," J. Infect. Diseases, Jan. 2014, 209(1):83-86.

Kuehne et al., "The role of toxin A and toxin B in Clostridium difficile infection," Nature, Oct. 2010, 467(7316):711-713.

Kuipers et al., "Clostridium difficile infection," The Lancet, May 2008, 371(9623):1486-1488.

Kuroda and DeGrado, "Amphiphilic polymethacrylate derivatives as antimicrobial agents," J Am Chem Soc., 2005, 127:4128-4129.

Kyne et al., "Asymptomatic carnage of Clostridium difficile and serum levels of IgG antibody against toxin A," N. Engl. J. Medicine, Feb. 2000, 342(6):390-397.

Lam et al., "Cost-effectiveness of three different strategies for the treatment of first recurrent Clostridium difficile infection diagnosed in a community setting," Infect. Control Hosp. Epidemiology, Aug. 2018, 39(8):924-930.

Leav et al., "Serum anti-toxin B antibody correlates with protection from recurrent Clostridium difficile infection (CDI)," Vaccine, Jan. 2010, 28(4):965-969.

Lee et al., "Bezlotoxumab (Zinplava) for Clostridium difficile infection: the first monoclonal antibody approved to prevent the recurrence of a bacterial infection," Pharm. Therapeutics, Dec. 2017, 42(12):735-738.

Leffler et al., "Clostridium difficile infection," N. Engl. J. Medicine, Apr. 2015, 372(16):1539-1548.

Lehner and Anton, "Mucosal immunity and vaccination against HIV," Aids 16 Suppl., 2002, 4:S125-132.

Lessa et al., "Burden of Clostridium difficile infection in the United States," N. Engl. J. Medicine, Feb. 2015, 372(9):825-834.

Lowy et al., "Treatment with monoclonal antibodies against Clostridium difficile toxins," N. Engl. J. Medicine, Jan. 2010, 362(3):197-205.

Lu et al., "Use of DNAs expressing HIV-1 env and noninfectious HIV-1 particles to raise antibody responses in mice," Virology, 1995, 209:147-154.

Lubeck et al., "Long-term protection of chimpanzees against high-dose HIV-1 challenge induced by immunization," Nat Med., 1997, 3:651-658.

Lyerly et al., "Characterization of toxins A and B of Clostridium difficile with monoclonal antibodies," Infect. Immunity, Oct. 1986, 54(1):70-76.

Lyerly et al., "Clostridium difficile: its disease and toxins," Clin. Microbiol. Reviews, Jan. 1988, 1(1):1-18.

Ma et al., "Increasing incidence of multiply recurrent Clostridium difficile infection in the United States: a cohort study," Ann. Intern. Medicine, Aug. 2017, 167(3):152-158.

Malkevitch et al., "A replication competent adenovirus 5 host range mutant-simian immunodeficiency virus (SiV) recombinant priming/subunit protein boosting vaccine regimen induces broad, persistent SIV-specific cellular immunity to dominant and subdominant epitopes in Mamu-A*01 rhesus macaques," J Immunol., 2003, 170:4281-4289.

Malkevitch et al., "Durable protection of rhesus macaques immunized with a replicating adenovirus-SIV multigene prime/protein boost vaccine regimen against a second SIVmac251 rectal challenge: role of SIV-specific CD8+ T cell responses," Virology, 2006, 353:83-98.

Matchett et al., "Divergent HIV-1-directed immune responses generated by systemic and mucosal immunization with replicating single-cycle adenoviruses in rhesus macaques," J. Virology, May 2019, 93(10):e02016-18, 18 pages.

Matchett et al., "Genetic Adjuvants in Replicating Single-Cycle Adenovirus Vectors Amplify Systemic and Mucosal Immune Responses against HIV-1 Envelope," Vaccines, Mar. 2020, 8(1):64, 13 pages.

Matthews, "Adenovirus protein V induces redistribution of nucleolin and B23 from nucleolus to cytoplasm," J Virol., 2001, 75:1031-1038.

Matyjaszewski and Xia, "Atom transfer radical polymerization," Chem Rev., 2001, 101:2921-2990.

McDonald et al., "Clinical practice guidelines for Clostridium difficile infection in adults and children: 2017 update by the Infectious Diseases Society of America (IDSA) and Society for Healthcare Epidemiology of America (SHEA)," Clin. Infect. Diseases, Mar. 2018, 66(7):e1-48.

McFarland et al., "Breaking the cycle: treatment strategies for 163 cases of recurrent Clostridium difficile disease," Am. J. Gastroenterology, Jul. 2002, 97(7):1769-1775.

Mennechet et al., "A review of 65 years of human adenovirus seroprevalence," Expert Rev. Vaccines, Jun. 2019, 18(6):597-613.

Mercier et al., "A chimeric adenovirus vector encoding reovirus attachment protein sigma1 targets cells expressing junctional adhesion molecule 1," Proc Natl Acad Sci USA, 2004, 101:6188-6193.

Mercier et al., "Oral immunization of rhesus macaques with adenoviral HIV vaccines using enteric-coated capsules," Vaccine, 2007, 25:8687-8701.

Mittall et al., "Immunization with DNA, adenovirus, or both in biodegradable alginate microspheres: effect of route of inoculation on immune response," Vaccine, 2000, 19:253-263.

Mok and Barry, "Evaluation of Polyethylene Glycol (PEG)-modification of First Generation and Helper-Dependent Adenoviral Vectors to Reduce Innate Immune Responses," Molecular Therapy, 2005, 11:66-79.

Mossman et al., "Protection against lethal simian immunodeficiency virus SIVsmmPBj14 disease by a recombinant Semliki Forest virus gp160 vaccine and by a gp120 subunit vaccine," J Virol., 1996, 70:1953-1960.

Mullard, "FDA approves antitoxin antibody," Nat. Rev. Drug Discovery, Nov. 2016, 15:811.

Munoz et al., "Disseminated adenovirus disease in immunocompromised and immunocompetent children," Clin. Infect. Diseases, Nov. 1998, 27(5):1194-1200.

Natuk et al., "Adenovirus-human immunodeficiency virus (HIV)envelope recombinant vaccines elicit high-titered HIV-neutralizing antibodies in the dog model," Proc Nat Acad Sci USA, 1992, 89:7777-7781.

Nehete et al., "A synthetic peptide from the first conserved region in the envelope protein gp160 is a strong T-cell epitope in HIV-infected chimpanzees and humans," Viral Immunol., 1998, 11:147-158.

Nehete et al., "Presence of HLA-C-restricted cytotoxic T-lymphocyte responses in long-term nonprogressors infected with human immunodeficiency virus," Viral Immunol., 1998, 11:119-129.

Nehete et al., "Protection against chronic infection and AIDS by an HIV envelope peptide-cocktail vaccine in a pathogenic SHIV-rhesus model," Vaccine, 2001, 20:813-825.

Nehete et al., "Protection by dendritic cells-based HIV synthetic peptide cocktail vaccine: preclinical studies in the SHIV-rhesus model," Vaccine, 2005, 23:2154-2159.

Nicklin et al., "The influence of adenovirus fiber structure and function on vector development for gene therapy," Mol Ther., 2005, 12:384-393.

Nyberg-Hoffman et al., "Sensitivity and reproducibility in adenoviral infectious titer determination," Nat. Medicine, Jul. 1997, 3(7):808-811.

Ohtani et al., "Quantitative analysis of p53-targeted gene expression and visualization of p53 transcriptional activity following intratumoral administration of adenoviral p53 in vivo," Molecular Cancer Therapeutics, 2004, 3(1):93-100.

Oren et al., "Clostridium difficile and Clostridioides difficile: two validly published and correct names," Anaerobe, Aug. 2018, 52:125-126.

O'Riordan et al., "PEGylation of adenovirus with retention of infectivity and protection from neutralizing antibody in vitro and in vivo," Hum Gene Ther., 1999, 10:1349-1358.

Orson et al., "Genetic immunization with lung-targeting macroaggregated polyethyleneimine-albumin conjugates elicits combined systemic and mucosal immune responses," J Immunol., 2000, 164:6313-6321.

Oualikene et al., "Protease-deleted adenovirus vectors and complementing cell lines: potential applications of single-round replication mutants for vaccination and gene therapy," Hum Gene Ther., 2000, 11:1341-1353.

(56) References Cited

OTHER PUBLICATIONS

Ourmanov et al., "Comparative efficacy of recombinant modified vaccinia virus Ankara expressing simian immunodeficiency virus (SIV) Gag-Pol and/or Env in macaques challenged with pathogenic SIV," J Virol., 2000, 74:2740-2751.

Parks et al., "Use of helper-dependent adenoviral vectors of alternative serotypes permits repeat vector administration," Gene Ther., 1999, 6:1565-1573.

Parr et al., "Immunity to vaginal infection by herpes simplex virus type 2 in adult mice: characterization of the immunoglobulins in vaginal mucus," J Reprod Immunol., 1998, 38:15-30.

Parrott et al., "Metabolically Biotinylated Adenovirus for Cell-targeting, Ligand Screening, and Vector Purification," Molecular Therapy, 2003, 8:689-702.

Patterson e al., "Protection against mucosal simian immunodeficiency virus SiV(mac251) challenge by using replicating adenovirus-SIV multigene vaccine priming and subunit boosting," J Virol., 2004, 78:2212-2221.

Péchiné et al., "Emerging monoclonal antibodies against Clostridium difficile infection," Expert Opin. Biol. Therapy, Apr. 2017, 17(4):415-427.

Peng et al., "Replicating rather than nonreplicating adenovirus-human immunodeficiency virus recombinant vaccines are better at eliciting potent cellular immunity and priming high-titer antibodies," J Virol., 2005, 79:10200-10209.

Pinczewski et al., "Enhanced immunity and protective efficacy against SIVmac251 intrarectal challenge following ad-SIV priming by multiple mucosal routes and gp120 boosting in MPL-SE," Viral Immunol., 2005, 18:236-243.

Qiu et al., "Novel Clostridium difficile anti-toxin (TcdA and TcdB) humanized monoclonal antibodies demonstrate in vitro neutralization across a broad spectrum of clinical strains and in vivo potency in a hamster spore challenge model," PLoS One, Jun. 2016, 11(6):e0157970, 21 pages.

Rees et al., "Adaptive immune response to Clostridium difficile infection: a perspective for prevention and therapy," Eur. J. Immunology, Mar. 2018, 48(3):398-406.

Richardson et al., "Airway delivery of an adenovirus-based Ebola virus vaccine bypasses existing immunity to homologous adenovirus in nonhuman primates," J. Virology, Apr. 2013, 87(7):3668-3677.

Robert-Guroff et al., "Vaccine protection against a heterologous, non-syncytium-inducing, primary human immunodeficiency virus," J. Virol., 1998, 72:10275-10280.

Rupnik et al., "An update on Clostridium difficile toxinotyping," J. Clin. Microbiology, Jan. 2016, 54(1):13-18.

Sakuma et al., "Biorecognizable HPMA copolymer-drug conjugates for colon-specific delivery of 9-aminocamptothecin," J Control Release, 2001, 75:365-379.

Sauerborn et al., "The C-terminal ligand-binding domain of Clostridium difficile toxin A (TcdA) abrogates TcdA-specific binding to cells and prevents mouse lethality," FEMS Microbiol. Letters, Oct. 1997, 55(1):45-54.

Seregin et al., "Adenovirus-based vaccination against Clostridium difficile toxin A allows for rapid humoral immunity and complete protection from toxin A lethal challenge in mice," Vaccine, Feb. 2012, 30(8):1492-1501.

Shashkova et al., "Targeting Interferon-I Increases Antitumor Efficacy and Reduces Hepatotoxicity of EIA-mutated Spread-enhanced Oncolytic Adenovirus," Mol. Ther., 2007, 15:598-607.

Sheldon et al., "A phase 1, placebo-controlled, randomized study of the safety, tolerability, and immunogenicity of a Clostridium difficile vaccine administered with or without aluminum hydroxide in healthy adults," Vaccine, Apr. 2016, 34(18):2082-2091.

Shields et al., "Recurrent Clostridium difficile infection: from colonization to cure," Anaerobe, Aug. 2015, 34:59-73.

Shiver et al., "Replication-incompetent adenoviral vaccine vector elicits effective anti-immunodeficiency-virus immunity," Nature, 2002, 415:331-335.

Shiver, "A non-replicating adenoviral vector as a potential HIV vaccine," Res Initiat Treat Action., 2003, 8:14-16.

Simecka, "Mucosal immunity of the gastrointestinal tract and oral tolerance," Adv Drug Deliv Rev., 1998, 34:235-259.

Singh and Barry, "Repertoire and immunofocusing of CD8 T cell responses generated by HIV-1 gag-pol and expression library immunization vaccines," Journal of Immunology, 2004, 173:4387-4393.

Singh et al., "Generation of genome-wide CD8 T cell responses in HLA-A*0201 transgenic mice by an HIV-1 ubiquitin expression library immunization vaccine," J Immunol., 2002, 168:379-391.

Sorg et al., "Inhibiting the initiation of Clostridium difficile spore germination using analogs of chenodeoxycholic acid, a bile acid," J. Bacteriology, Oct. 2010, 192(19):4983-4990.

Spencer et al., "Vaccination against Clostridium difficile using toxin fragments: Observations and analysis in animal models," Gut Microbes, Mar. 2014, 5(2):225-232.

Surawicz et al., "Guidelines for Diagnosis, Treatment, and Prevention of Clostridium difficile Infections," Am. J. Gastroenterology, April 2013, 108(4):478-498.

Thomas et al., "Use of the Syrian hamster as an animal model for oncolytic adenovirus vectors," Methods Viol Med., 2007, 130:169-183.

Top et al., "Immunization with live types 7 and 4 adenovirus vaccines. II. Antibody response and protective effect against acute respiratory disease due to adenovirus type 7," J Infect Dis., 1971, 124:155-160.

Usala et al., "IgG and IgA content of vaginal fluid during the menstrual cycle," J Reprod Med., 1989, 34:292-294.

Vancikova, "Mucosal immunity-basic principles, ontogeny, cystic fibrosis and mucosal vaccination," Curr Drug Targets Immune Endocr Metabol Disord., 2002, 2:83-95.

Vogels et al., "Replication-deficient human adenovirus type 35 vectors for gene transfer and vaccination: efficient human cell infection and bypass of preexisting adenovirus immunity," J. Virology, Aug. 2003, 77(15):8263-71.

Vogels et al., "Replication-deficient human adenovirus type 35 vectors for gene transfer and vaccination: efficient human cell infection and bypass of preexisting adenovirus immunity," J Virol., 2003, 77:8263-8271.

Wagner et al., "Safety and immunogenicity of recombinant human immunodeficiency virus-like particles in rodents and rhesus macaques," Intervirology, 1996, 39:93-103.

Wang et al., "Gene inoculation generates immune responses against human immunodeficiency virus type 1," Proceedings of the National Academy of Sciences USA, 1993, 90:4156-4160.

Wang, "Induction of humoral and cellular immune responses to the human immunodeficiency type 1 virus in nonhuman primates by in vivo DNA inoculation," Virology, 1995, 211:102-112.

Weaver et al., "Comparison of systemic and mucosal immunization with helper-dependent adenoviruses for vaccination against mucosal challenge with SHIV," PLoS one, Jul. 2013, 8(7):e67574, 12 pages.

Wickham et al., "Integrins $\alpha v \beta 3$ and $\alpha v \beta 5$ promote adenovirus internalization but not virus attachment," Cell, 1993, 73:309-319.

Wilcox et al., "Bezlotoxumab for prevention of recurrent Clostridium difficile infection," N. Engl. J. Medicine, Jan. 2017, 376(4):305-317.

Wu and Barry, "Fusion protein vectors to increase protein production and evaluate the immunogenicity of genetic vaccines," Molecular Therapy, 2000, 2:288-297.

Wu and Nemerow. "Virus yoga: the role of flexibility in virus host cell recognition," Trends Microbiol., 2004, 12:162-169.

Xiang et al., "Oral vaccination of mice with adenoviral vectors is not impaired by preexisting immunity to the vaccine carrier," J Virol., 2003, 77:10780-10789.

Xie et al., "Development and optimization of a novel assay to measure neutralizing antibodies against Clostridium difficile toxins," Clin. Vaccine Immunology, Apr. 2013, 20(4):517-25.

Yamshchikov et al., "Assembly of SIV virus-like particles containing envelope proteins using a baculovirus expression system," Virology, 1995, 214:50-58.

Yao, "Enhancement of Mucosal Immune Responses by Chimeric Influenza HA/SHIV Virus-Like Particles," Res Initiat Treat Action, 2003, 8:20-21.

(56) References Cited

OTHER PUBLICATIONS

Zhao et al., "Boosting of SIV-specifie immune responses in rhesus macaques by repeated administration of Ad5hr-SIVenv/rev and Ad5hr-SIVgag recombinants," Vaccine, 2003, 21:4022-4035.

Zhao et al., "Enhanced cellular immunity to SIV Gag following co-administration of adenoviruses encoding wild-type or mutant HIV Tat and SIV Gag," Virology, 2005, 342:1-12.

Dicks et al., "A Novel Chimpanzee Adenovirus Vector with Low Human Seroprevalence: Improved Systems for Vector Derivation and Comparative Immunogenicity," PLoS One, Jul. 13, 2012, 7(7):e40385, 12 pages.

Tostanoski et al., "Ad26 vaccine protects against SARS-CoV-2 severe clinical disease in hamsters," Nat. Medicine, Sep. 3, 2020, 26(11):1694-1700.

\* cited by examiner

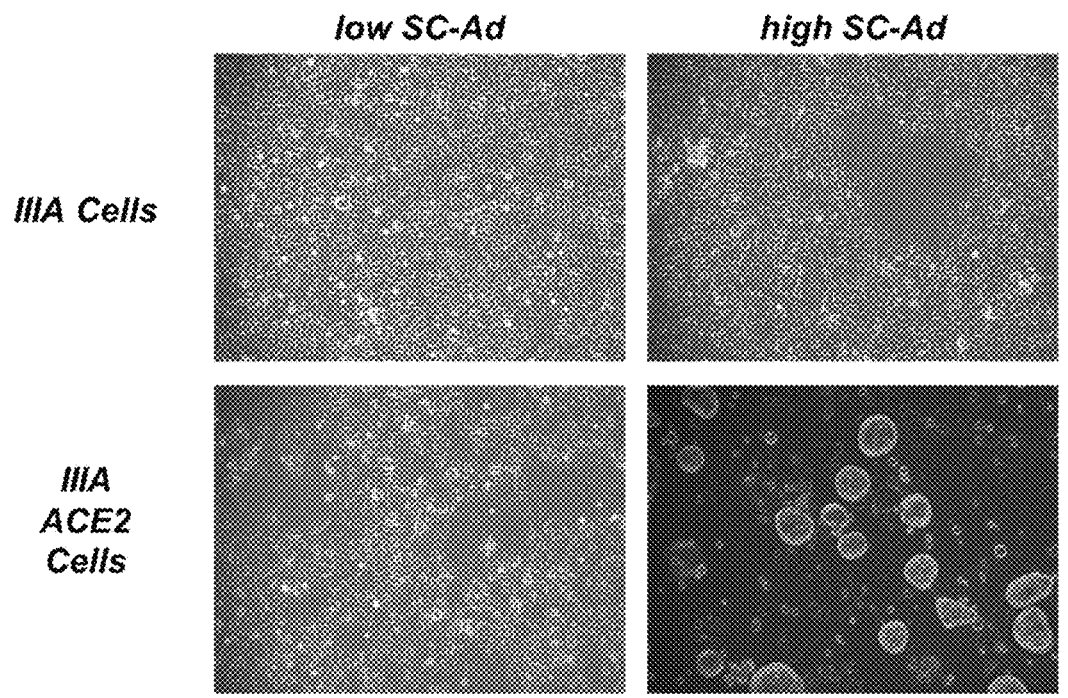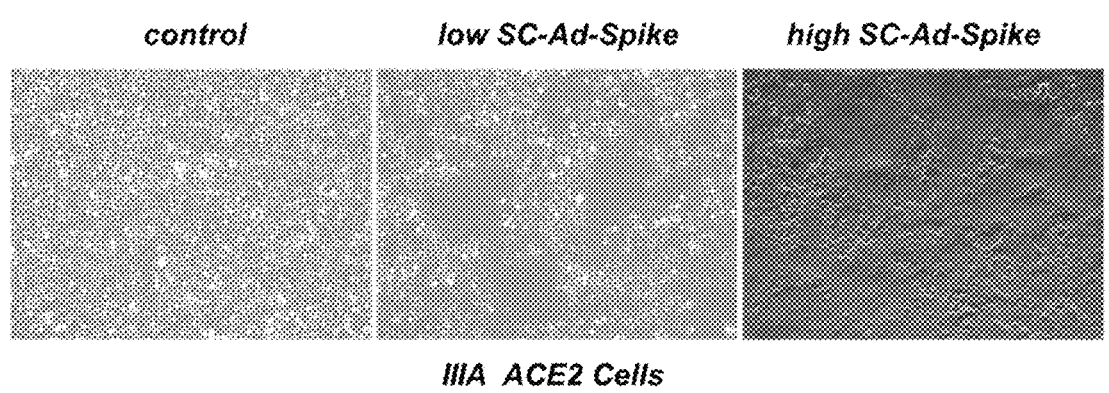
FIG. 15

SC-Ad Carrying Centralized Influenza Hemagglutinin Antigen Genes

FIG. 23

SEQ ID NO:1

```
MFVFLVLLPLVSSQCVNLTTRTQLPPAYTNSFTRGVYYPDKVFRSSVLHSTQDLFLPFFSNVTW
FHAIHVSGTNGTKRFDNPVLPFNDGVYFASTEKSNIIRGWIFGTTLDSKTQSLLIVNNATNVVI
KVCEFQFCNDPFLGVYYHKNNKSWMESEFRVYSSANNCTFEYVSQPFLMDLEGKQGNFKNLREF
VFKNIDGYFKIYSKHTPINLVRDLPQGFSALEPLVDLPIGINITRFQTLLALHRSYLTPGDSSS
GWTAGAAAYYVGYLQPRTFLLKYNENGTITDAVDCALDPLSETKCTLKSFTVEKGIYQTSNFRV
QPTESIVRFPNITNLCPFGEVFNATRFASVYAWNRKRISNCVADYSVLYNSASFSTFKCYGVSP
TKLNDLCFTNVYADSFVIRGDEVRQIAPGQTGKIADYNYKLPDDFTGCVIAWNSNNLDSKVGGN
YNYLYRLFRKSNLKPFERDISTEIYQAGSTPCNGVEGFNCYFPLQSYGFQPTNGVGYQPYRVVV
LSFELLHAPATVCGPKKSTNLVKNKCVNFNFNGLTGTGVLTESNKKFLPFQQFGRDIADTTDAV
RDPQTLEILDITPCSFGGVSVITPGTNTSNQVAVLYQDVNCTEVPVAIHADQLTPTWRVYSTGS
NVFQTRAGCLIGAEHVNNSYECDIPIGAGICASYQTQTNSPRRARSVASQSIIAYTMSLGAENS
VAYSNNSIAIPTNFTISVTTEILPVSMTKTSVDCTMYICGDSTECSNLLLQYGSFCTQLNRALT
GIAVEQDKNTQEVFAQVKQIYKTPPIKDFGGFNFSQILPDPSKPSKRSFIEDLLFNKVTLADAG
FIKQYGDCLGDIAARDLICAQKFNGLTVLPPLLTDEMIAQYTSALLAGTITSGWTFGAGAALQI
PFAMQMAYRFNGIGVTQNVLYENQKLIANQFNSAIGKIQDSLSSTASALGKLQDVVNQNAQALN
TLVKQLSSNFGAISSVLNDILSRLDKVEAEVQIDRLITGRLQSLQTYVTQQLIRAAEIRASANL
AATKMSECVLGQSKRVDFCGKGYHLMSFPQSAPHGVVFLHVTYVPAQEKNFTTAPAICHDGKAH
FPREGVFVSNGTHWFVTQRNFYEPQIITTDNTFVSGNCDVVIGIVNNTVYDPLQPELDSFKEEL
DKYFKNHTSPDVDLGDISGINASVVNIQKEIDRLNEVAKNLNESLIDLQELGKYEQYIKWPWYI
WLGFIAGLIAIVMVTIMLCCMTSCCSCLKGCCSCGSCCKFDEDDSEPVLKGVKLHYT
```

FIG. 28

SEQ ID NO:2

```
MFVFLVLLPLVSSQCVNLTTRTQLPPAYTNSFTRGVYYPDKVFRSSVLHSTQDLFLPFFSNVTW
FHAIHVSGTNGTKRFDNPVLPFNDGVYFASTEKSNIIRGWIFGTTLDSKTQSLLIVNNATNVVI
KVCEFQFCNDPFLGVYYHKNNKSWMESEFRVYSSANNCTFEYVSQPFLMDLEGKQGNFKNLREF
VFKNIDGYFKIYSKHTPINLVRDLPQGFSALEPLVDLPIGINITRFQTLLALHRSYLTPGDSSS
GWTAGAAAYYVGYLQPRTFLLKYNENGTITDAVDCALDPLSETKCTLKSFTVEKGIYQTSNFRV
QPTESIVRFPNITNLCPFGEVFNATRFASVYAWNRKRISNCVADYSVLYNSASFSTFKCYGVSP
TKLNDLCFTNVYADSFVIRGDEVRQIAPGQTGKIADYNYKLPDDFTGCVIAWNSNNLDSKVGGN
YNYLYRLFRKSNLKPFERDISTEIYQAGSTPCNGVEGFNCYFPLQSYGFQPTNGVGYQPYRVVV
LSFELLHAPATVCGPKKSTNLVKNKCVNFNFNGLTGTGVLTESNKKFLPFQQFGRDIADTTDAV
RDPQTLEILDITPCSFGGVSVITPGTNTSNQVAVLYQDVNCTEVPVAIHADQLTPTWRVYSTGS
NVFQTRAGCLIGAEHVNNSYECDIPIGAGICASYQTQTNSPRRARSVASQSIIAYTMSLGAENS
VAYSNNSIAIPTNFTISVTTEILPVSMTKTSVDCTMYICGDSTECSNLLLQYGSFCTQLNRALT
GIAVEQDKNTQEVFAQVKQIYKTPPIKDFGGFNFSQILPDPSKPSKRSFIEDLLFNKVTLADAG
FIKQYGDCLGDIAARDLICAQKFNGLTVLPPLLTDEMIAQYTSALLAGTITSGWTFGAGAALQI
PFAMQMAYRFNGIGVTQNVLYENQKLIANQFNSAIGKIQDSLSSTASALGKLQDVVNQNAQALN
TLVKQLSSNFGAISSVLNDILSRLDKVEAEVQIDRLITGRLQSLQTYVTQQLIRAAEIRASANL
AATKMSECVLGQSKRVDFCGKGYHLMSFPQSAPHGVVFLHVTYVPAQEKNFTTAPAICHDGKAH
FPREGVFVSNGTHWFVTQRNFYEPQIITTDNTFVSGNCDVVIGIVNNTVYDPLQPELDSFKEEL
DKYFKNHTSPDVDLGDISGINASVVNIQKEIDRLNEVAKNLNESLIDLQELGKYEQYIKWPWYI
WLGFIAGLIAIVMVTIMLCCMTSCCSCLKGCCSCGSCCKFDEDDSEPVLKGV
```

FIG. 29

SEQ ID NO:3

```
MFVFLVLLPLVSSQCVNLTTRTQLPPAYTNSFTRGVYYPDKVFRSSVLHSTQDLFLPFFSNVTW
FHAIHVSGTNGTKRFDNPVLPFNDGVYFASTEKSNIIRGWIFGTTLDSKTQSLLIVNNATNVVI
KVCEFQFCNDPFLGVYYHKNNKSWMESEFRVYSSANNCTFEYVSQPFLMDLEGKQGNFKNLREF
VFKNIDGYFKIYSKHTPINLVRDLPQGFSALEPLVDLPIGINITRFQTLLALHRSYLTPGDSSS
GWTAGAAAYYVGYLQPRTFLLKYNENGTITDAVDCALDPLSETKCTLKSFTVEKGIYQTSNFRV
QPTESIVRFPNITNLCPFGEVFNATRFASVYAWNRKRISNCVADYSVLYNSASFSTFKCYGVSP
TKLNDLCFTNVYADSFVIRGDEVRQIAPGQTGKIADYNYKLPDDFTGCVIAWNSNNLDSKVGGN
YNYLYRLFRKSNLKPFERDISTEIYQAGSTPCNGVEGFNCYFPLQSYGFQPTNGVGYQPYRVVV
LSFELLHAPATVCGPKKSTNLVKNKCVNFNFNGLTGTGVLTESNKKFLPFQQFGRDIADTTDAV
RDPQTLEILDITPCSFGGVSVITPGTNTSNQVAVLYQDVNCTEVPVAIHADQLTPTWRVYSTGS
NVFQTRAGCLIGAEHVNNSYECDIPIGAGICASYQTQTNSPRRARSVASQSIIAYTMSLGAENS
VAYSNNSIAIPTNFTISVTTEILPVSMTKTSVDCTMYICGDSTECSNLLLQYGSFCTQLNRALT
GIAVEQDKNTQEVFAQVKQIYKTPPIKDFGGFNFSQILPDPSKPSKRSFIEDLLFNKVTLADAG
FIKQYGDCLGDIAARDLICAQKFNGLTVLPPLLTDEMIAQYTSALLAGTITSGWTFGAGAALQI
PFAMQMAYRFNGIGVTQNVLYENQKLIANQFNSAIGKIQDSLSSTASALGKLQDVVNQNAQALN
TLVKQLSSNFGAISSVLNDILSRLDKVEAEVQIDRLITGRLQSLQTYVTQQLIRAAEIRASANL
AATKMSECVLGQSKRVDFCGKGYHLMSFPQSAPHGVVFLHVTYVPAQEKNFTTAPAICHDGKAH
FPREGVFVSNGTHWFVTQRNFYEPQIITTDNTFVSGNCDVVIGIVNNTVYDPLQPELDSFKEEL
DKYFKNHTSPDVDLGDISGINASVVNIQKEIDRLNEVAKNLNESLIDLQELGKYEQYI
```

FIG. 30

SEQ ID NO:4

MFVFLVLLPLVSSQCVNLTTRTQLPPAYTNSFTRGVYYPDKVFRSSVLHSTQDLFLPFFSNVTW
FHAIHVSGTNGTKRFDNPVLPFNDGVYFASTEKSNIIRGWIFGTTLDSKTQSLLIVNNATNVVI
KVCEFQFCNDPFLGVYYHKNNKSWMESEFRVYSSANNCTFEYVSQPFLMDLEGKQGNFKNLREF
VFKNIDGYFKIYSKHTPINLVRDLPQGFSALEPLVDLPIGINITRFQTLLALHRSYLTPGDSSS
GWTAGAAAYYVGYLQPRTFLLKYNENGTITDAVDCALDPLSETKCTLKSFTVEKGIYQTSNFRV
QPTESIVRFPNITNLCPF

FIG. 31

SEQ ID NO:5

```
DPLQPRTFLLKYNENGTITDAVDCALDPLSETKCTLKSFTVEKGIYQTSNFRVQPTESIVRFPN
ITNLCPFGEVFNATRFASVYAWNRKRISNCVADYSVLYNSASFSTFKCYGVSPTKLNDLCFTNV
YADSFVIRGDEVRQIAPGQTGKIADYNYKLPDDFTGCVIAWNSNNLDSKVGGNYNYLYRLFRKS
NLKPFERDISTEIYQAGSTPCNGVEGFNCYFPLQSYGFQPTNGVGYQPYRVVVLSFELLHAPAT
VCGPKKSTNLCCVECPPCPAPPVAGPSVFLFPPKPKDTLMISRTPEVTCVVVDVSHEDPEVQFN
WYVDGVEVHNAKTKPREEQFNSTFRVVSVLTVVHQDWLNGKEYKCKVSNKGLPAPIEKTISKTK
GQPREPQVYTLPPSREEMTKNQVSLTCLVKGFYPSDIAVEWESNGQPENNYKTTPPMLDSDGSF
FLYSKLTVDKSRWQQGNVFSCSVMHEALHNHYTQKSLSLSPGK
```

FIG. 32

SEQ ID NO:6

DPLQPRTFLLKYNENGTITDAVDCALDPLSETKCTLKSFTVEKGIYQTSNFRVQPTESIVRFPN
ITNLCPFGEVFNATRFASVYAWNRKRISNCVADYSVLYNSASFSTFKCYGVSPTKLNDLCFTNV
YADSFVIRGDEVRQIAPGQTGKIADYNYKLPDDFTGCVIAWNSNNLDSKVGGNYNYLYRLFRKS
NLKPFERDISTEIYQAGSTPCNGVEGFNCYFPLQSYGFQPTNGVGYQPYRVVVLSFELLHAPAT
VCGPKKSTNLCCVECPPCPAPPVAGTMGGAAGSGAAEAGITGTWYNQLGSTFIVTAGADGALTG
TYESAVGNAESRYVLTGRYESAPATDGSGTALGWTVAWKNNYRNAHSATTWSGQYVGGAEARIN
TQWLLTSGTTEANAWKSTLVGHDTFTKVKPSAASGS

FIG. 33

SEQ ID NO:7

DPLQPRTFLLKYNENGTITDAVDCALDPLSETKCTLKSFTVEKGIYQTSNFRVQPTESIVRFPN
ITNLCPFGEVFNATRFASVYAWNRKRISNCVADYSVLYNSASFSTFKCYGVSPTKLNDLCFTNV
YADSFVIRGDEVRQIAPGQTGKIADYNYKLPDDFTGCVIAWNSNNLDSKVGGNYNYLYRLFRKS
NLKPFERDISTEIYQAGSTPCNGVEGFNCYFPLQSYGFQPTNGVGYQPYRVVVLSFELLHAPAT
VCGPKKSTNLCCVECPPCPAPPVAGSKGLESRVSALEKTSQIHSDTILRITQGLDDANKRIIAL
EQSRDDLVASVSDAQLAISRLESSIGALQTVVNGLDSSVTQLGARVGQLETGLAELRVDHDNLV
ARVDTAERNIGSLTTELSTLTLRVTSI

FIG. 34

SEQ ID NO:8

MSSSSWLLLSLVAVTAAQSTIEEQAKTFLDKFNHEAEDLFYQSSLASWNYNTNITEENVQNMNN
AGDKWSAFLKEQSTLAQMYPLQEIQNLTVKLQLQALQQNGSSVLSEDKSKRLNTILNTMSTIYS
TGKVCNPDNPQECLLLEPGLNEIMANSLDYNERLWAWESWRSEVGKQLRPLYEEYVVLKNEMAR
ANHYEDYGDYWRGDYEVNGVDGYDYSRGQLIEDVEHTFEEIKPLYEHLHAYVRAKLMNAYPSYI
SPIGCLPAHLLGDMWGRFWTNLYSLTVPFGQKPNIDVTDAMVDQAWDAQRIFKEAEKFFVSVGL
PNMTQGFWENSMLTDPGNVQKAVCHPTAWDLGKGDFRILMCTKVTMDDFLTAHHEMGHIQYDMA
YAAQPFLLRNGANEGFHEAVGEIMSLSAATPKHLKSIGLLSPDFQEDNETEINFLLKQALTIVG
TLPFTYMLEKWRWMVFKGEIPKDQWMKKWWEMKREIVGVVEPVPHDETYCDPASLFHVSNDYSF
IRYYTRTLYQFQFQEALCQAAKHEGPLHKCDISNSTEAGQKLFNMLRLGKSEPWTLALENVVGA
KNMNVRPLLNYFEPLFTWLKDQNKNSFVGWSTDWSPYADQSIKVRISLKSALGDKAYEWNDNEM
YLFRSSVAYAMRQYFLKVKNQMILFGEEDVRVANLKPRISFNFFVTAPKNVSDIIPRTEVEKAI
RMSRSRINDAFRLNDNSLEFLGIQPTLGPPNQPPVS

FIG. 35

SEQ ID NO:9

```
MSSSSWLLLSLVAVTAAQSTIEEQAKTFLDKFNHEAEDLFYQSSLASWNYNTNITEENVQNMNN
AGDKWSAFLKEQSTLAQMYPLQEIQNLTVKLQLQALQQNGSSVLSEDKSKRLNTILNTMSTIYS
TGKVCNPDNPQECLLLEPGLNEIMANSLDYNERLWAWESWRSEVGKQLRPLYEEYVVLKNEMAR
ANHYEDYGDYWRGDYEVNGVDGYDYSRGQLIEDVEHTFEEIKPLYEHLHAYVRAKLMNAYPSYI
SPIGCLPAHLLGDMWGRFWTNLYSLTVPFGQKPNIDVTDAMVDQAWDAQRIFKEAEKFFVSVGL
PNMTQGFWENSMLTDPGNVQKAVCLPTAWDLGKGDFRILMCTKVTMDDFLTAHHEMGHIQYDMA
YAAQPFLLRNGANEGFHEAVGEIMSLSAATPKHLKSIGLLSPDFQEDNETEINFLLKQALTIVG
TLPFTYMLEKWRWMVFKGEIPKDQWMKKWWEMKREIVGVVEPVPHDETYCDPASLFHVSNDYSF
IRYYTRTLYQFQFQEALCQAAKHEGPLHKCDISNSTEAGQKLFNMLRLGKSEPWTLALENVVGA
KNMNVRPLLNYFEPLFTWLKDQNKNSFVGWSTDWSPYADQSIKVRISLKSALGDKAYEWNDNEM
YLFRSSVAYAMRQYFLKVKNQMILFGEEDVRVANLKPRISFNFFVTAPKNVSDIIPRTEVEKAI
RMSRSRINDAFRLNDNSLEFLGIQPTLGPPNQPPVS
```

FIG. 36

SEQ ID NO:22

FNLVTGWQTINGKKYYFDINTGAALISYKIINGKHFYFNNDGVMQLGVFKGPDGFEYFAPANTQ
NNNIEGQAIVYQSKFLTLNGKKYYFDQDSKAVTGWRIINNEKYYFNPNNAIAAVGLQVIDNNKY
YFNPDTAIISKGWQTVQGSRYYFDTDTAIAFNGYKTIDGKHFYFDSDCVVKIGVFSTSNGFEYF
APANTYNNNIEGQAIVYQSKFLTLNGKKYYFDQNSKAVTGWQTIDSKKYYFNTNTAEAATGWQT
IDGKKYYFNTNTAEAATGWQTIDGKKYYFNTNTAIASTGYTIINGKHFYFNTDGIMQIGVFKGP
NGFEYFAPANTDANNIEGQAILYQNEFLTLNGKKYYFGSDSKAVTGWRIINNKKYYFNPNNAIA
AIHLCTINNDKYYFSYDGILQNGYITIERNNFYFDANQESKMVTGVFKGPNGFEYFAPANTHNN
NIEGQAIVYQNKFLTLNGKKYYFDQDSKAVTGWQTIDGKKYYFNLNTAEAATGWQTIDGKKYYF
NLNTAEAATGWQTIDGKKYYFNTNTFIASTGYTSINGKHFYFNTDGIMQIGVFKGPNGFEYFAP
ANTHNNNIEGQAILYQNKFLTLNGKKYYFGSDSKAVTGLRTIDGKKYYFNTNTAVAVTGWQTIN
GKKYYFNTQTSIASTGYTIISGKHFYFNTDGIMQIGVFKGPDGFEYFAPANTDANNIEGQAIRY
QNRFLYLHDNIYYFGQNSKAATGWVTIDGNRYYFEPNTAMGANGYKTIDNKNFYFRNGLPQIGV
FKGSNGFEYFAPANTDANNIEGQAIRYQNRFLHLLGKIYYFGQNSKAVTGWQTINGKVYYFMPD
TAMAAAGGLFEIDGVIYFFGVDGVKAPGIYG

FIG. 37A

SEQ ID NO:23

NLITGFVTVGDDKYYFNPINGGAASIGETIIDDKNYYFQQSGVLQTGVFSTEDGFKYFAPANTL
DENLEGEAIDFTGKLIIDENIYYFDDNYRGAVEWKELDGEMHYFSPETGKAFKGLNQIGDYKYY
FNSDGVMQKGFVSINDNKHYFDDSGVMKVGYTEIDGKHFYFAENGEMQIGVFNTEDGFKYFAHH
NEDLGNEEGEEISYSGILNFNNKIYYFDDSFTAVVGWKDLEDGSKYYFDEDTAEAYIGLSLIND
GQYYFNDDGIMQVGFVTINDKVFYFSDSGIIESGVQNIDDNYFYIDDNGIVQIGVFDTSDGYKY
FAPANTVNDNIYGQAVEYSGLVRVGEDVYYFGETYTIETGWIYDMEQESDKYYFNPETKKACKG
INLIDDIKYYFDEKGIMRTGLISFENNNYYFNENGEMQFGYINIEDKMFYFGEDGVMQIGVFNT
PDGFKYFAHQNTLDENFEGESIQYTGWLDLDEKRYYFTDEYIAATGSVIIDGEEYYFDPDTAQL
VISE

FIG. 37B

SEQ ID NO:10

MPSSVSWGILLLAGLCCLVPVSLAEDPMPSSVSWGILLLAGLCCLVPVSLAEDPFNLVTGWQTI
NGKKYYFDINTGAALISYKIINGKHFYFNNDGVMQLGVFKGPDGFEYFAPANTQNNNIEGQAIV
YQSKFLTLNGKKYYFDQDSKAVTGWRIINNEKYYFNPNNAIAAVGLQVIDNNKYYFNPDTAIIS
KGWQTVQGSRYYFDTDTAIAFNGYKTIDGKHFYFDSDCVVKIGVFSTSNGFEYFAPANTYNNNI
EGQAIVYQSKFLT

FIG. 37C

SEQ ID NO:11

MESLVPGFNEKTHVQLSLPVLQVRDVLVRGFGDSVEEVLSEARQHLKDGTCGLVEVEKGVLPQL
EQPYVFIKRSDARTAPHGHVMVELVAELEGIQYGRSGETLGVLVPHVGEIPVAYRKVLLRKNGN
KGAGGHSYGADLKSFDLGDELGTDPYEDFQENWNTKHSSGVTRELMRELNGGAYTRYVDNNFCG
PDGYPLECIKDLLARAGKASCTLSEQLDFIDTKRGVYCCREHEHEIAWYTERSEKSYELQTPFE
IKLAKKFDTFNGECPNFVFPLNSIIKTIQPRVEKKKLDGFMGRIRSVYPVASPNECNQMCLSTL
MKCDHCGETSWQTGDFVKATCEFCGTENLTKEGATTCGYLPQNAVVKIYCPACHNSEVGPEHSL
AEYHNESGLKTILRKGGRTIAFGGCVFSYVGCHNKCAYWVPRASANIGCNHTGVVGEGSEGLND
NLLEILQKEKVNINIVGDFKLNEEIAIILASFSASTSAFVETVKGLDYKAFKQIVESCGNFKVT
KGKAKKGAWNIGEQKSILSPLYAFASEAARVVRSIFSRTLETAQNSVRVLQKAAITILDGISQY
SLRLIDAMMFTSDLATNNLVVMAYITGGVVQLTSQWLTNIFGTVYEKLKPVLDWLEEKFKEGVE
FLRDGWEIVKFISTCACEIVGGQIVTCAKEIKESVQTFFKLVNKFLALCADSIIGGAKLKALN
LGETFVTHSKGLYRKCVKSREETGLLMPLKAPKEIIFLEGETLPTEVLTEEVVLKTGDLQPLEQ
PTSEAVEAPLVGTPVCINGLMLLEIKDTEKYCALAPNMMVTNNTFTLKGGAPTKVTFGDDTVIE
VQGYKSVNITFELDERIDKVLNEKCSAYTVELGTEVNEFACVVADAVIKTLQPVSELLTPLGID
LDEWSMATYYLFDESGEFKLASHMYCSFYPPDEDEEEGDCEEEEFEPSTQYEYGTEDDYQGKPL
EFGATSAALQPEEEQEEDWLDDDSQQTVGQQDGSEDNQTTTIQTIVEVQPQLEMELTPVVQTIE
VNSFSGYLKLTDNVYIKNADIVEEAKKVKPTVVVNAANVYLKHGGGVAGALNKATNNAMQVESD
DYIATNGPLKVGGSCVLSGHNLAKHCLHVVGPNVNKGEDIQLLKSAYENFNQHEVLLAPLLSAG
IFGADPIHSLRVCVDTVRTNVYLAVFDKNLYDKLVSSFLEMKSEKQVEQKIAEIPKEEVKPFIT
ESKPSVEQRKQDDKKIKACVEEVTTTLEETKFLTENLLLYIDINGNLHPDSATLVSDIDITFLK
KDAPYIVGDVVQEGVLTAVVIPTKKAGGTTEMLAKALRKVPTDNYITTYPGQGLNGYTVEEAKT
VLKKCKSAFYILPSIISNEKQEILGTVSWNLREMLAHAEETRKLMPVCVETKAIVSTIQRKYKG
IKIQEGVVDYGARFYFYTSKTTVASLINTLNDLNETLVTMPLGYVTHGLNLEEAARYMRSLKVP
ATVSVSSPDAVTAYNGYLTSSSKTPEEHFIETISLAGSYKDWSYSGQSTQLGIEFLKRGDKSVY
YTSNPTTFHLDGEVITFDNLKTLLSLREVRTIKVFTTVDNINLHTQVVDMSMTYGQQFGPTYLD
GADVTKIKPHNSHEGKTFYVLPNDDTLRVEAFEYYHTTDPSFLGRYMSALNHTKKWKYPQVNGL
TSIKWADNNCYLATALLTLQQIELKFNPPALQDAYYRARAGEAANFCALILAYCNKTVGELGDV
RETMSYLFQHANLDSCKRVLNVVCKTCGQQQTTLKGVEAVMYMGTLSYEQFKKGVQIPCTCGKQ
ATKYLVQQESPFVMMSAPPAQYELKHGTFTCASEYTGNYQCGHYKHITSKETLYCIDGALLTKS
SEYKGPITDVFYKENSYTTTIKPVTYKLDGVVCTEIDPKLDNYYKKDNSYFTEQPIDLVPNQPY
PNASFDNFKFVCDNIKFADDLNQLTGYKKPASRELKVTFFPDLNGDVVAIDYKHYTPSFKKGAK
LLHKPIVWHVNNATNKATYKPNTWCIRCLWSTKPVETSNSFDVLKSEDAQGMDNLACEDLKPVS
EEVVENPTIQKDVLECNVKTTEVVGDIILKPANNSLKITEEVGHTDLMAAYVDNSSLTIKKPNE
LSRVLGLKTLATHGLAAVNSVPWDTIANYAKPFLNKVVSTTTNIVTRCLNRVCTNYMPYFFTLL
LQLCTFTRSTNSRIKASMPTTIAKNTVKSVGKFCLEASFNYLKSPNFSKLINIIWFLLLSVCL
GSLIYSTAALGVLMSNLGMPSYCTGYREGYLNSTNVTIATYCTGSIPCSVCLSGLDSLDTYPSL
ETIQITISSFKWDLTAFGLVAEWFLAYILFTRFFYVLGLAAIMQLFFSYFAVHFISNSWLMWLI
INLVQMAPISAMVRMYIFFASFYYVWKSYVHVVDGCNSSTCMMCYKRNRATRVECTTIVNGVRR
SFYVYANGGKGFCKLHNWNCVNCDTFCAGSTFISDEVARDLSLQFKRPINPTDQSSYIVDSVTV
KNGSIHLYFDKAGQKTYERHSLSHFVNLDNLRANNTKGSLPINVIVFDGKSKCEESSAKSASVY
YSQLMCQPILLLDQALVSDVGDSAEVAVKMFDAYVNTFSSTFNVPMEKLKTLVATAEAELAKNV
SLDNVLSTFISAARQGFVDSDVETKDVVECLKLSHQSDIEVTGDSCNNYMLTYNKVENMTPRDL

FIG. 38

SEQ ID NO:11 (continued)

```
GACIDCSARHINAQVAKSHNIALIWNVKDFMSLSEQLRKQIRSAAKKNNLPFKLTCATTRQVVN
VVTTKIALKGGKIVNNWLKQLIKVTLVFLFVAAIFYLITPVHVMSKHTDFSSEIIGYKAIDGGV
TRDIASTDTCFANKHADFDTWFSQRGGSYTNDKACPLIAAVITREVGFVVPGLPGTILRTTNGD
FLHFLPRVFSAVGNICYTPSKLIEYTDFATSACVLAAECTIFKDASGKPVPYCYDTNVLEGSVA
YESLRPDTRYVLMDGSIIQFPNTYLEGSVRVVTTFDSEYCRHGTCERSEAGVCVSTSGRWVLNN
DYYRSLPGVFCGVDAVNLLTNMFTPLIQPIGALDISASIVAGGIVAIVVTCLAYYFMRFRRAFG
EYSHVVAFNTLLFLMSFTVLCLTPVYSFLPGVYSVIYLYLTFYLTNDVSFLAHIQWMVMFTPLV
PFWITIAYIICISTKHFYWFFSNYLKRRVVFNGVSFSTFEEAALCTFLLNKEMYLKLRSDVLLP
LTQYNRYLALYNKYKYFSGAMDTTSYREAACCHLAKALNDFSNSGSDVLYQPPQTSITSAVLQS
GFRKMAFPSGKVEGCMVQVTCGTTTLNGLWLDDVVYCPRHVICTSEDMLNPNYEDLLIRKSNHN
FLVQAGNVQLRVIGHSMQNCVLKLKVDTANPKTPKYKFVRIQPGQTFSVLACYNGSPSGVYQCA
MRPNFTIKGSFLNGSCGSVGFNIDYDCVSFCYMHHMELPTGVHAGTDLEGNFYGPFVDRQTAQA
AGTDTTITVNVLAWLYAAVINGDRWFLNRFTTTLNDFNLVAMKYNYEPLTQDHVDILGPLSAQT
GIAVLDMCASLKELLQNGMNGRTILGSALLEDEFTPFDVVRQCSGVTFQSAVKRTIKGTHHWLL
LTILTSLLVLVQSTQWSLFFFLYENAFLPFAMGIIAMSAFAMMFVKHKHAFLCLFLLPSLATVA
YFNMVYMPASWVMRIMTWLDMVDTSLSGFKLKDCVMYASAVVLLILMTARTVYDDGARRVWTLM
NVLTLVYKVYYGNALDQAISMWALIISVTSNYSGVVTTVMFLARGIVFMCVEYCPIFFITGNTL
QCIMLVYCFLGYFCTCYFGLFCLLNRYFRLTLGVYDYLVSTQEFRYMNSQGLLPPKNSIDAFKL
NIKLLGVGGKPCIKVATVQSKMSDVKCTSVVLLSVLQQLRVESSSKLWAQCVQLHNDILLAKDT
TEAFEKMVSLLSVLLSMQGAVDINKLCEEMLDNRATLQAIASEFSSLPSYAAFATAQEAYEQAV
ANGDSEVVLKKLKKSLNVAKSEFDRDAAMQRKLEKMADQAMTQMYKQARSEDKRAKVTSAMQTM
LFTMLRKLDNDALNNIINNARDGCVPLNIIPLTTAAKLMVVIPDYNTYKNTCDGTTFTYASALW
EIQQVVDADSKIVQLSEISMDNSPNLAWPLIVTALRANSAVKLQNNELSPVALRQMSCAAGTTQ
TACTDDNALAYYNTTKGGRFVLALLSDLQDLKWARFPKSDGTGTIYTELEPPCRFVTDTPKGPK
VKYLYFIKGLNNLNRGMVLGSLAATVRLQAGNATEVPANSTVLSFCAFAVDAAKAYKDYLASGG
QPITNCVKMLCTHTGTGQAITVTPEANMDQESFGGASCCLYCRCHIDHPNPKGFCDLKGKYVQI
PTTCANDPVGFTLKNTVCTVCGMWKGYGCSCDQLREPMLQSADAQSFLNRVCGVSAARLTPCGT
GTSTDVVYRAFDIYNDKVAGFAKFLKTNCCRFQEKDEDDNLIDSYFVVKRHTFSNYQHEETIYN
LLKDCPAVAKHDFFKFRIDGDMVPHISRQRLTKYTMADLVYALRHFDEGNCDTLKEILVTYNCC
DDDYFNKKDWYDFVENPDILRVYANLGERVRQALLKTVQFCDAMRNAGIVGVLTLDNQDLNGNW
YDFGDFIQTTPGSGVPVVDSYYSLLMPILTLTRALTAESHVDTDLTKPYIKWDLLKYDFTEERL
KLFDRYFKYWDQTYHPNCVNCLDDRCILHCANFNVLFSTVFPPTSFGPLVRKIFVDGVPFVVST
GYHFRELGVVHNQDVNLHSSRLSFKELLVYAADPAMHAASGNLLLDKRTTCFSVAALTNNVAFQ
TVKPGNFNKDFYDFAVSKGFFKEGSSVELKHFFFAQDGNAAISDYDYYRYNLPTMCDIRQLLFV
VEVVDKYFDCYDGGCINANQVIVNNLDKSAGFPFNKWGKARLYYDSMSYEDQDALFAYTKRNVI
PTITQMNLKYAISAKNRARTVAGVSICSTMTNRQFHQKLLKSIAATRGATVVIGTSKFYGGWHN
MLKTVYSDVENPHLMGWDYPKCDRAMPNMLRIMASLVLARKHTTCCSLSHRFYRLANECAQVLS
EMVMCGGSLYVKPGGTSSGDATTAYANSVFNICQAVTANVNALLSTDGNKIADKYVRNLQHRLY
ECLYRNRDVDTDFVNEFYAYLRKHFSMMILSDDAVVCFNSTYASQGLVASIKNFKSVLYYQNNV
FMSEAKCWTETDLTKGPHEFCSQHTMLVKQGDDYVYLPYPDPSRILGAGCFVDDIVKTDGTLMI
ERFVSLAIDAYPLTKHPNQEYADVFHLYLQYIRKLHDELTGHMLDMYSVMLTNDNTSRYWEPEF
YEAMYTPHTVLQAVGACVLCNSQTSLRCGACIRRPFLCCKCCYDHVISTSHKLVLSVNPYVCNA
PGCDVTDVTQLYLGGMSYYCKSHKPPISFPLCANGQVFGLYKNTCVGSDNVTDFNAIATCDWTN
AGDYILANTCTERLKLFAAETLKATEETFKLSYGIATVREVLSDRELHLSWEVGKPRPPLNRNY
VFTGYRVTKNSKVQIGEYTFEKGDYGDAVVYRGTTTYKLNVGDYFVLTSHTVMPLSAPTLVPQE
HYVRITGLYPTLNISDEFSSNVANYQKVGMQKYSTLQGPPGTGKSHFAIGLALYYPSARIVYTA
CSHAAVDALCEKALKYLPIDKCSRIIPARARVECFDKFKVNSTLEQYVFCTVNALPETTADIVV
```

FIG. 38 (continued)

SEQ ID NO:11 (continued)

```
FDEISMATNYDLSVVNARLRAKHYVYIGDPAQLPAPRTLLTKGTLEPEYFNSVCRLMKTIGPDM
FLGTCRRCPAEIVDTVSALVYDNKLKAHKDKSAQCFKMFYKGVITHDVSSAINRPQIGVVREFL
TRNPAWRKAVFISPYNSQNAVASKILGLPTQTVDSSQGSEYDYVIFTQTTETAHSCNVNRFNVA
ITRAKVGILCIMSDRDLYDKLQFTSLEIPRRNVATLQAENVTGLFKDCSKVITGLHPTQAPTHL
SVDTKFKTEGLCVDIPGIPKDMTYRRLISMMGFKMNYQVNGYPNMFITREEAIRHVRAWIGFDV
EGCHATREAVGTNLPLQLGFSTGVNLVAVPTGYVDTPNNTDFSRVSAKPPPGDQFKHLIPLMYK
GLPWNVVRIKIVQMLSDTLKNLSDRVVFVLWAHGFELTSMKYFVKIGPERTCCLCDRRATCFST
ASDTYACWHHSIGFDYVYNPFMIDVQQWGFTGNLQSNHDLYCQVHGNAHVASCDAIMTRCLAVH
ECFVKRVDWTIEYPIIGDELKINAACRKVQHMVVKAALLADKFPVLHDIGNPKAIKCVPQADVE
WKFYDAQPCSDKAYKIEELFYSYATHSDKFTDGVCLFWNCNVDRYPANSIVCRFDTRVLSNLNL
PGCDGGSLYVNKHAFHTPAFDKSAFVNLKQLPFFYYSDSPCESHGKQVVSDIDYVPLKSATCIT
RCNLGGAVCRHHANEYRLYLDAYNMMISAGFSLWVYKQFDTYNLWNTFTRLQSLENVAFNVVNK
GHFDGQQGEVPVSIINNTVYTKVDGVDVELFENKTTLPVNVAFELWAKRNIKPVPEVKILNNLG
VDIAANTVIWDYKRDAPAHISTIGVCSMTDIAKKPTETICAPLTVFFDGRVDGQVDLFRNARNG
VLITEGSVKGLQPSVGPKQASLNGVTLIGEAVKTQFNYYKKVDGVVQQLPETYFTQSRNLQEFK
PRSQMEIDFLELAMDEFIERYKLEGYAFEHIVYGDFSHSQLGGLHLLIGLAKRFKESPFELEDF
IPMDSTVKNYFITDAQTGSSKCVCSVIDLLLDDFVEIIKSQDLSVVSKVVKVTIDYTEISFMLW
CKDGHVETFYPKLQSSQAWQPGVAMPNLYKMQRMLLEKCDLQNYGDSATLPKGIMMNVAKYTQL
CQYLNTLTLAVPYNMRVIHFGAGSDKGVAPGTAVLRQWLPTGTLLVDSDLNDFVSDADSTLIGD
CATVHTANKWDLIISDMYDPKTKNVTKENDSKEGFFTYICGFIQQKLALGGSVAIKITEHSWNA
DLYKLMGHFAWWTAFVTNVNASSSEAFLIGCNYLGKPREQIDGYVMHANYIFWRNTNPIQLSSY
SLFDMSKFPLKLRGTAVMSLKEGQINDMILSLLSKGRLIIRENNRVVISSDVLVNN
```

FIG. 38 (continued)

SEQ ID NO:12

```
MFVFLVLLPLVSSQCVNLTTRTQLPPAYTNSFTRGVYYPDKVFRSSVLHSTQDLFLPFFSNVTW
FHAIHVSGTNGTKRFDNPVLPFNDGVYFASTEKSNIIRGWIFGTTLDSKTQSLLIVNNATNVVI
KVCEFQFCNDPFLGVYYHKNNKSWMESEFRVYSSANNCTFEYVSQPFLMDLEGKQGNFKNLREF
VFKNIDGYFKIYSKHTPINLVRDLPQGFSALEPLVDLPIGINITRFQTLLALHRSYLTPGDSSS
GWTAGAAAYYVGYLQPRTFLLKYNENGTITDAVDCALDPLSETKCTLKSFTVEKGIYQTSNFRV
QPTESIVRFPNITNLCPFGEVFNATRFASVYAWNRKRISNCVADYSVLYNSASFSTFKCYGVSP
TKLNDLCFTNVYADSFVIRGDEVRQIAPGQTGKIADYNYKLPDDFTGCVIAWNSNNLDSKVGGN
YNYLYRLFRKSNLKPFERDISTEIYQAGSTPCNGVEGFNCYFPLQSYGFQPTNGVGYQPYRVVV
LSFELLHAPATVCGPKKSTNLVKNKCVNFNFNGLTGTVLTESNKKFLPFQQFGRDIADTTDAV
RDPQTLEILDITPCSFGGVSVITPGTNTSNQVAVLYQDVNCTEVPVAIHADQLTPTWRVYSTGS
NVFQTRAGCLIGAEHVNNSYECDIPIGAGICASYQTQTNSPRRARSVASQSIIAYTMSLGAENS
VAYSNNSIAIPTNFTISVTTEILPVSMTKTSVDCTMYICGDSTECSNLLLQYGSFCTQLNRALT
GIAVEQDKNTQEVFAQVKQIYKTPPIKDFGGFNFSQILPDPSKPSKRSFIEDLLFNKVTLADAG
FIKQYGDCLGDIAARDLICAQKFNGLTVLPPLLTDEMIAQYTSALLAGTITSGWTFGAGAALQI
PFAMQMAYRFNGIGVTQNVLYENQKLIANQFNSAIGKIQDSLSSTASALGKLQDVVNQNAQALN
TLVKQLSSNFGAISSVLNDILSRLDKVEAEVQIDRLITGRLQSLQTYVTQQLIRAAEIRASANL
AATKMSECVLGQSKRVDFCGKGYHLMSFPQSAPHGVVFLHVTYVPAQEKNFTTAPAICHDGKAH
FPREGVFVSNGTHWFVTQRNFYEPQIITTDNTFVSGNCDVVIGIVNNTVYDPLQPELDSFKEEL
DKYFKNHTSPDVDLGDISGINASVVNIQKEIDRLNEVAKNLNESLIDLQELGKYEQYIKWPWYI
WLGFIAGLIAIVMVTIMLCCMTSCCSCLKGCCSCGSCCKFDEDDSE
```

FIG. 39

SEQ ID NO:13

MDLFMRIFTIGTVTLKQGEIKDATPSDFVRATATIPIQASLPFGWLIVGVALLAVFQSASKIIT
LKKRWQLALSKGVHFVCNLLLLFVTVYSHLLLVAAGLEAPFLYLYALVYFLQSINFVRIIMRLW
LCWKCRSKNPLLYDANYFLCWHTNCYDYCIPYNSVTSSIVITSGDGTTSPISEHDYQIGGYTEK
WESGVKDCVVLHSYFTSDYYQLYSTQLSTDTGVEHVTFFIYNKIVDEPEEHVQIHTIDGSSGVV
NPVMEPIYDEPTTTTSVPL

FIG. 40

SEQ ID NO:14

MYSFVSEETGTLIVNSVLLFLAFVVFLLVTLAILTALRLCAYCCNIVNVSLVKPSFYVYSRVKN
LNSSRVPDLLV

FIG. 41

SEQ ID NO:15

MADSNGTITVEELKKLLEQWNLVIGFLFLTWICLLQFAYANRNRFLYIIKLIFLWLLWPVTLAC
FVLAAVYRINWITGGIAIAMACLVGLMWLSYFIASFRLFARTRSMWSFNPETNILLNVPLHGTI
LTRPLLESELVIGAVILRGHLRIAGHHLGRCDIKDLPKEITVATSRTLSYYKLGASQRVAGDSG
FAAYSRYRIGNYKLNTDHSSSSDNIA

FIG. 42

SEQ ID NO:16

MFHLVDFQVTIAEILLIIMRTFKVSIWNLDYIINLIIKNLSKSL

FIG. 43

SEQ ID NO:17

MKIILFLALITLATCELYHYQECVRGTTVLLKEPCSSGTYEGNSPFHPLADNKFALTCFSTQFA
FACPDGVKHVYQLRARSVSPKLFIRQEEVQELYSPIFLIVAAIVFITLCFTLKRKTE

FIG. 44

SEQ ID NO:18

MKFLVFLGIITTVAAFHQECSLQSCTQHQPYVVDDPCPIHFYSKWYIRVGARKSAPLIELCVDE
AGSKSPIQYIDIGNYTVSCSPFTINCQEPKLGSLVVRCSFYEDFLEYHDVRVVLDFI

FIG. 45

SEQ ID NO:19

```
MSDNGPQNQRNAPRITFGGPSDSTGSNQNGERSGARSKQRRPQGLPNNTASWFTALTQHGKEDL
KFPRGQGVPINTNSSPDDQIGYYRRATRRIRGGDGKMKDLSPRWYFYYLGTGPEAGLPYGANKD
GIIWVATEGALNTPKDHIGTRNPANNAAIVLQLPQGTTLPKGFYAEGSRGGSQASSRSSSRSRN
SSRNSTPGSSRGTSPARMAGNGGDAALALLLLDRLNQLESKMSGKGQQQQGQTVTKKSAAEASK
KPRQKRTATKAYNVTQAFGRRGPEQTQGNFGDQELIRQGTDYKHWPQIAQFAPSASAFFGMSRI
GMEVTPSGTWLTYTGAIKLDDKDPNFKDQVILLNKHIDAYKTFPPTEPKKDKKKKADETQALPQ
RQKKQQTVTLLPAADLDDFSKQLQQSMSSADSTQA
```

FIG. 46

SEQ ID NO:20

MKAKLLVLLCAFTATDADTICIGYHANNSTDTVDTVLEKNVTVTHSVNLLEDSHNGKLCKLKGI
APLQLGKCNIAGWILGNPECESLISKRSWSYIVETPNSENGTCYPGDFADYEELREQLSSVSSF
ERFEIFPKESSWPNHNVTKGVTAACSHAGKSSFYRNLLWLTEKNGSYPKLSKSYVNNKEKEVLV
LWGVHHPSNITDQRTLYQNENAYVSVVSSHYNRRFTPEIAKRPKVRGQAGRINYYWTLLEPGDT
IIFEANGNLIAPWYAFALSRGFGSGIITSNAPMHECDTKCQTPQGAINSSLPFQNVHPVTIGEC
PKYVRSTKLRMVTGLRNIPSIQSRGLFGAIAGFIEGGWTGMIDGWYGYHHQNEQGSGYAADQKS
TQNAINGITNKVNSVIEKMNTQFTAVGKEFNKLEKRMENLNKKVDDGFLDIWTYNAELLVLLEN
ERTLDFHDSNVKNLYEKVKSQLKNNAKEIGNGCFEFYHKCNNECMESVKNGTYDYPKYSEESKL
NREKIDGVKLESMGVYQILAIYSTVASSLVLLVSLGAISFWMCSNGSLQCRICI

FIG. 47

SEQ ID NO:21

MKVKLLILLCTFTATYADTICIGYHANNSTTYVDTITEDNVTVTHATELLESSHNGKLCNLPGV
RPLDLGDCSIAGWLLGNPECDLLQNEEWSYIVERSNPANGWCYPGDFPDYEELRSLLASVSSFE
KLEIIPEGFSWTNHTQNGGSGACKRGGKSSFFRNLNWLTKKGSTYPVLNVSYWNNDNEDKLYIW
GVHHPSTDQEQTSLYQNASGYVSVSTSTSQQRIIPNIASRPTVRGQSGRISFYWTIVAPGDVIV
FWSNGNLIAPRYWFKMNAGKSGIMKSDAPIGTCITKCQTPNGAINTSKPFQNVHPITIGECPKY
VKSNRLKLATGLRNVPEKQTRGLFGAIAGFIEGGWQGMIDGWYGYHHQNPQGSGYAADLKSTQA
AIDGITGKVNIVIEKMNTQFHAVGKEFNELECRIENLNKKVEDGFIDLWTYNAELLVLLENERT
LDFHDSNVKNLYEKVRRQLRENAKEIGNGCFEFYHKCDNECMESVRNGTYDYPKYREEAKKNRF
QIKGVKLKSGYKNQILWISFTTVSTLLLVVVLGGIFWCCGNGSLKCRICI

FIG. 48

SEQ ID NO:24

```
TTTAATCTGGTGACAGGCTGGCAGACTATCAATGGGAAGAAATACTATTTCGACATTAACACCGGCGCCG
CTCTGATCAGCTACAAGATCATTAACGGGAAACACTTCTACTTCAACAATGACGGAGTGATGCAGCTGGG
CGTCTTTAAGGGCCCCGATGGGTTCGAGTACTTCGCACCTGCCAATACACAGAACAATAACATTGAAGGA
CAGGCCATCGTGTATCAGTCCAAATTCCTGACTCTGAACGGCAAGAAATACTATTTTGACCAGGATTCTA
AGGCCGTCACCGGGTGGCGAATCATTAATAACGAGAAGTACTACTTCAACCCCAATAACGCTATTGCAGC
CGTGGGCCTGCAGGTCATCGACAATAACAAGTACTATTTCAACCCTGATACTGCCATCATTTCCAAAGGA
TGGCAGACCGTGCAGGGCTCTCGCTACTATTTCGACACCGATACAGCCATCGCCTTCAACGGGTACAAGA
CCATCGACGGAAAACATTTCTATTTTGACTCAGATTGCGTGGTCAAGATCGGCGTGTTCAGCACCTCCAA
CGGCTTCGAGTACTTTGCCCCAGCTAACACATACAACAACAACATCGAGGGCCAGGCCATCGTGTACCAG
AGCAAGTTCCTGACCCTGAATGGCAAGAAATACTACTTCGACCAGAACTCTAAGGCAGTCACCGGGTGGC
AGACAATCGATAGTAAGAAGTACTACTTCAACACTAACACCGCCGAGGCTGCAACTGGCTGGCAGACCAT
CGACGGGAAGAAATATTATTTCAATACAAACACTGCCGAAGCCGCTACAGGATGGCAGACTATTGACGGC
AAGAAATATTACTTCAACACCAACACAGCAATCGCCTCTACAGGGTACACTATCATTAATGGAAAGCACT
TCTACTTCAACACTGATGGGATCATGCAGATTGGAGTGTTCAAAGGACCAAATGGCTTCGAGTACTTTGC
TCCCGCAAACACAGACGCCAACAATATTGAGGGCCAGGCTATCCTGTATCAGAATGAATTCCTGACACTG
AACGGCAAGAAATATTATTTTGGGTCTGATAGTAAGGCTGTGACTGGCTGGAGGATCATTAACAATAAGA
AGTACTATTTCAACCCCAACAACGCAATCGCAGCCATTCACCTGTGCACCATTAACAATGACAAGTACTA
CTTCAGCTACGACGGCATCCTGCAGAATGGGTATATCACAATTGAGCGCAACAATTTCTACTTTGACGCC
AACCAGGAATCCAAGATGGTGACCGGCGTCTTCAAAGGGCCTAATGGATTTGAATATTCGCCCCAGCTA
ACACACATAATAACAATATCGAGGGGCAGGCTATCGTGTATCAGAATAAGTTCCTGACCCTGAACGGCAA
GAAATACTACTTTGACCAGGATAGCAAAGCCGTGACCGGATGGCAGACAATCGATGGCAAGAAATATTAT
TTCAATCTGAACACAGCCGAGGCCGCAACTGGGTGGCAGACCATCGATGGAAAGAAATACTACTTCAACC
TGAACACTGCTGAAGCCGCTACCGGATGGCAGACTATCGACGGGAAGAAATACTATTTCAATACTAACAC
CTTTATTGCCTCTACCGGATACACAAGTATCAATGGCAAGCACTTCTACTTCAACACGGATGGAATCATG
CAGATTGGCGTGTTCAAAGGCCCCAACGGATTTGAATACTTTGCACCTGCCAACACTCATAATAACAATA
TTGAAGGCCAGGCTATCCTGTACCAAAATAAGTTCCTGACCCTGAACGGGAAGAAATATTACTTCGGATC
AGACAGCAAAGCCGTGACCGGCCTGAGGACAATCGATGGGAAGAAATATTATTTCAATACGAACACTGCT
GTGGCAGTCACTGGATGGCAGACCATTAATGGCAAGAAATATTACTTCAACACGCAGACAAGCATCGCCT
CCACTGGGTACACCATCATTAGCGGAAAGCACTTCTACTTCAACACCGACGGCATTATGCAGATCGGAGT
GTTCAAAGGCCCTGATGGATTTGAGTACTTTGCCCCCGCTAATACAGATGCAAATAACATTGAAGGCCAG
GCCATCCGATACCAGAACCGGTTCCTGTATCTGCATGACAATATCTACTATTTTGGCCAGAACTCCAAGG
CAGCCACAGGCTGGGTGACTATCGATGGGAATCGGTACTATTTCGAGCCTAATACAGCTATGGGGCAAA
CGGATACAAGACTATCGATAACAAGAACTTCTACTTCCGGAATGGCCTGCCTCAGATCGGGGTGTTTAAG
GGCAGCAACGGATTCGAGTACTTTGCACCAGCCAACACCGACGCCAATAATATTGAAGGCCAGGCAATCA
GATACCAGAACAGGTTCCTGCATCTGCTGGGCAAAATCTACTACTTCGGCCAGAATTCCAAAGCAGTGAC
TGGCTGGCAGACAATCAACGGAAAGGTCTACTACTTCATGCCTGACACAGCAATGGCTGCAGCCGGCGGA
CTGTTCGAGATTGACGGCGTGATCTACTTCTTTGGAGTGGATGGCGTCAAAGCACCTGGAATCTACGGA
```

FIG. 49

SEQ ID NO:25

AACCTGATCACTGGATTCGTGACCGTCGGCGACGATAAGTACTACTTCAACCCTATTAACGGAG
GCGCTGCATCCATCGGCGAGACCATCATCGACGATAAGAACTACTACTTCCAGCAGAGTGGGGT
GCTGCAGACAGGAGTCTTCTCAACTGAGGACGGCTTCAAGTACTTTGCTCCAGCAAATACCCTG
GATGAAAACCTGGAGGGAGAAGCCATTGACTTTACAGGCAAGCTGATCATCGATGAAAACATCT
ACTACTTCGACGATAACTACCGCGGAGCTGTGGAGTGGAAAGAACTGGACGGCGAGATGCACTA
TTTCTCTCCAGAAACCGGCAAGGCCTTCAAGGGGCTGAATCAGATCGGAGACTACAAGTACTAT
TTCAACAGCGATGGCGTGATGCAGAAGGGGTTTGTCTCCATCAATGACAACAAACACTACTTCG
ACGATAGCGGAGTGATGAAGGTCGGCTACACCGAGATTGATGGCAAACATTTCTATTTTGCTGA
GAATGGGGAAATGCAAATCGGAGTGTTCAACACAGAAGATGGCTTCAAGTACTTTGCCCACCAT
AATGAGGACCTGGGCAACGAGGAAGGGGAGGAAATTTCCTACTCTGGCATCCTGAACTTCAACA
ACAAAATCTACTATTTCGACGATAGCTTCACCGCAGTGGTGGGATGGAAGGACCTGGAGGATGG
AAGCAAATACTATTTTGACGAGGATACCGCCGAAGCTTACATTGGCCTGTCCCTGATCAATGAC
GGGCAGTACTACTTCAACGACGATGGCATTATGCAAGTGGGGTTCGTCACCATCAACGACAAGG
TGTTCTACTTTAGTGATTCAGGAATCATTGAGTCTGGCGTCCAGAATATTGACGATAACTACTT
CTATATCGACGATAATGGGATCGTGCAGATTGGAGTCTTCGACACCAGCGATGGGTACAAGTAT
TTTGCACCCGCCAACACCGTGAATGACAACATCTACGGCCAGGCCGTCGAGTATTCAGGCCTGG
TGCGGGTCGGGGAAGACGTGTACTATTTCGGCGAGACTTACACCATTGAAACAGGGTGGATCTA
TGACATGGAGCAAGAAAGTGATAAGTACTATTTCAATCCTGAGACTAAGAAAGCCTGCAAAGGC
ATCAACCTGATTGACGATATCAAGTACTACTTCGATGAGAAGGGAATCATGAGAACCGGCCTGA
TCAGCTTCGAAAACAATAACTACTACTTCAACGAGAACGGGGAAATGCAGTTCGGATACATCAA
CATCGAGGACAAGATGTTCTACTTCGGGGAAGATGGAGTGATGCAGATCGGAGTCTTTAACACA
CCCGACGGCTTCAAATACTTTGCCCACCAGAATACTCTGGATGAGAACTTCGAGGGGAATCTA
TCCAGTACACCGGATGGCTGGACCTGGATGAGAAGAGGTACTATTTCACCGACGAGTACATCGC
CGCTACAGGCAGTGTGATTATCGACGGCGAGGAGTATTACTTCGATCCCGACACCGCTCAGCTG
GTCATCTCAGAG

FIG. 50

SEQ ID NO:26

CGCCATCATCAATAATATACCTTATTTTGGATTGAAGCCAATATGATAATGAGGGGGTGGAGTTTGTGAC
GTGGCGCGGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTACGTGGAGACTCGCCCAGGTGTTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGGTAAAGAGGGAGCGGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGGTGGTTATTATGA
ATGTGAGGTTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGGTGGTGTGTCGCCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC

FIG. 51

SEQ ID NO:26 (continued)

```
GCACCAGGTGCAGACCCTGCGAGTGTGGCGGTAAACATATTAGGAACCAGCCTGTGATGCTGGATGTGAC
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGATATGAG
ATGCATCTTGGACTGTATTTTAGGTTGGCTATGTTCCAGCCATATCCCTCCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGGATCATGTCTACCTG
CGGGGCGATGAAGAAAACCGTTTCCGGGGTAGGGGAGATCAGCTGGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGGCCACTTCGTTAAGCATGTCCCTGACTTGCATGTTTTCCCT
GACCAAATCCGCCAGAAGGCGCTCGCCGCCCAGCGATAGCAGTTCTTGCAAGGAAGCAAAGTTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGGCGCCGCACGAGGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCTGGTCAGAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGACCCCATGGCATGGGTGGGTGAGCGCGGAGGCG
TACATGCCGCAAATGTCGTAAACGTAGAGGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
```

FIG. 51 (continued)

SEQ ID NO:26 (continued)

```
CGCGCAGCTTGTTGACCAGCTCGGCGGTGACCTGCACGTCTAGGGCGCAGTAGTCCAGGGTTTCCTTGAT
GATGTCATACTTATCCTGTCCCTTTTTTTTCCACAGCTCGCGGTTGAGGACAAACTCTTCGCGGTCTTTC
CAGTACTCTTGGATCGGAAACCCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAGTCCGTGCGCTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCGCGGCGCGACTACGGTACCGCGCGG
CGGGCGGTGGGCCGCGGGGTGTCCTTGGATGATGCATCTAAAAGCGGTGACGCGGGCGGGCCCCCGGAG
GTAGGGGGGCTCGGGACCCGCGGGAGAGGGGGCAGGGCACGTCGGCGCCGCGCGGGCAGGAGCTG
GTGCTGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCAAGGCCTCAAGGCGCTCCATGGCCTCGTAGAAGTCCACGG
CGAAGTTGAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGCCTCTTCTTCTTCTTCAATCTCCTCTTCCATA
AGGGCCTCCCCTTCTTCTTCTTCTGGCGGCGGTGGGGGAGGGGGGACACGGCGGCGACGACGGCGCACCG
GGAGGCGGTCGACAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAGTGCGGCGGCGG
CTGGCGGTAGAGGGGCCAGCGTAGGGTGGCCGGGGCTCCGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
```

FIG. 51 (continued)

SEQ ID NO:26 (continued)

```
TAAATTCGCAAGGGTATCATGGCGGACGACCGGGGTTCGAACCCCGGATCCGGCCGTCCGCCGTGATCCA
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGTTTGACCCCGTCACTGGTCTTGTCATGCCTGGGGTATATA
CAAACGAAGCCTTCCATCCAGACATCATTTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCCGGTGGTGGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTTGGCGCGCCCGCCAGCCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GGCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
```

SEQ ID NO:26 (continued)

```
ACACCCAGTGCGCGTGCGCGGGCACTACCGCGCGCCCTGGGGCGCGCACAAACGCGGCCGCACTGGGCGC
ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAAGAAGAGATGCTCCAGGTCATCGCGCCGGAGATCTA
TGGCCCCCGAAGAAGGAAGAGCAGGATTACAAGCCCCGAAAGCTAAAGCGGGTCAAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCGAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCCGGCGTCCGCGCCGTTCAAGGAAGTACGGCGCCGCCAGCGCGCTACTGCCCGAATATGCCCT
ACATCCTTCCATCGCGCCTACCCCCGGCTATCGTGGCTACACCTACCGCCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAATAAAAGTCTGGACTCTCACGCTCGCTTGGTCCTGTAACTATTTT
GTAGAATGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CCGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTTTGGGGGTGCAATCCCTGAAGCGCCGACGATGCTTCTGATAGCTAACGTGT
CGTATGTGTGTCATGTATGCGTCCATGTCGCCGCCAGAGGAGCTGCTGAGCCGCCGCGCGCCCGCTTTCC
AAGATGGCTACCCCTTCGATGATGCCGCAGTGGTCTTACATGCACATCTCGGGCCAGGACGCCTCGGAGT
ACCTGAGCCCCGGGCTGGTGCAGTTCGCCCGCGCCACCGAGACGTACTTCAGCCTGAATAACAAGTTTAG
AAACCCCACGGTGGCGCCTACGCACGACGTGACCACAGACCGGTCTCAGCGTTTGACGCTGCGGTTCATC
CCCGTGGACCGCGAGGATACTGCGTACTCGTACAAGGCGCGGTTCACCCTAGCTGTGGGTGATAACCGTG
TGCTAGACATGGCTTCCACGTACTTTGACATCCGCGGCGTGCTGGACAGGGCCCTACTTTAAGCCCTA
CTCTGGCACTGCCTACAACGCACTGGCCCCAAGGGTGCCCCAACTCGTGCGAGTGGGAACAAAATGAA
ACTGCACAAGTGGATGCTCAAGAACTTGACGAAGAGGAGAATGAAGCCAATGAAGCTCAGGCGCGAGAAC
AGGAACAAGCTAAGAAAACCCATGTATATGCCCAGGCTCCACTGTCCGGAATAAAAATAACTAAAGAAGG
TCTACAAATAGGAACTGCCGACGCCACAGTAGCAGGTGCCGGCAAAGAAATTTTCGCAGACAAAACTTTT
CAACCTGAACCACAAGTAGGAGAATCTCAATGGAACGAAGCGGATGCCACAGCAGCTGGTGGAAGGGTTC
TTAAAAAGACAACTCCCATGAAACCCTGCTATGGCTCATACGCTAGACCCACCAATTCCAACGGCGGACA
```

SEQ ID NO:26

```
GGGCGTTATGGTTGAACAAAATGGTAAATTGGAAAGTCAAGTCGAAATGCAATTTTTTTCCACATCCACA
AATGCCACAAATGAAGTTAACAATATACAACCAACAGTTGTATTGTACAGCGAAGATGTAAACATGGAAA
CTCCAGATACTCATCTTTCTTATAAACCTAAAATGGGGGATAAAAATGCCAAAGTCATGCTTGGACAACA
AGCAATGCCAAACAGACCAAATTACATTGCTTTTAGAGACAATTTTATTGGTCTCATGTATTACAACAGC
ACAGGTAACATGGGTGTCCTTGCTGGTCAGGCATCGCAGTTGAACGCTGTTGTAGATTTGCAAGACAGAA
ACACAGAGCTGTCCTACCAGCTTTTGCTTGATTCAATTGGCGACAGAACAAGATACTTTTCAATGTGGAA
TCAAGCTGTTGACAGCTATGATCCAGATGTCAGAATTATTGAGAACCATGGAACTGAGGATGAGTTGCCA
AATTATTGCTTTCCTCTTGGTGGAATTGGGATTACTGACACTTTTCAAGCTGTTAAAACAACTGCTGCTA
ACGGGGACCAAGGCAATACTACCTGGCAAAAGATTCAACATTTGCAGAACGCAATGAAATAGGGGTGGG
AAATAACTTTGCCATGGAAATTAACCTGAATGCCAACCTATGGAGAAATTTCCTTTACTCCAATATTGCG
CTGTACCTGCCAGACAAGCTAAAATACAACCCCACCAATGTGGAAATATCTGACAACCCCAACACCTACG
ACTACATGAACAAGCGAGTGGTGGCTCCTGGGCTTGTAGACTGCTACATTAACCTTGGGGCGCGCTGGTC
TCTGGACTACATGGACAACGTTAATCCCTTTAACCACCCCGCCATGCGGGCCTGCGTTACCGCTCCATG
TTGTTGGGAAACGGCCGCTACGTGCCCTTTCACATTCAGGTGCCCCAAAAGTTTTTGCCATTAAAAACC
TCCTCCTCCTGCCAGGCTCATACACATATGAATGGAACTTCAGGAAGGATGTTAACATGGTTCTGCAGAG
CTCTCTGGGAAACGACCTTAGAGTTGACGGGGCTAGCATTAAGTTTGACAGCATTTGTCTTTACGCCACC
TTCTTCCCCATGGCCCACAACACGGCCTCCACGCTGGAAGCCATGCTCAGAAATGACACCAACGACCAGT
CCTTTAATGACTACCTTTCCGCCGCCAACATGCTATATCCCATACCCGCCAACGCCACCAACGTGCCCAT
CTCCATCCCATCGCGCAACTGGGCAGCATTTCGCGGTTGGGCCTTCACACGCTTGAAGACAAAGGAAACC
CCTTCCCTGGGATCAGGCTACGACCCTTACTACACCTACTCTGGCTCCATACCATACCTTGACGGAACCT
TCTATCTTAATCACACCTTTAAGAAGGTGGCCATTACTTTTGACTCTTCTGTTAGCTGGCCGGGCAACGA
CCGCCTGCTTACTCCCAATGAGTTTGAGATTAAGCGCTCAGTTGACGGGGAGGGCTATAACGTAGCTCAG
TGCAACATGACAAAGGACTGGTTCCTAGTGCAGATGTTGGCCAACTACAATATTGGCTACCAGGGCTTCT
ACATTCCAGAAAGCTACAAAGACCGCATGTACTCGTTCTTCAGAAACTTCCAGCCCATGAGCCGGCAAGT
GGTGGACGATACTAAATACAAAGATTATCAGCAGGTTGGAATTATCCACCAGCATAACAACTCAGGCTTC
GTAGGCTACCTCGCTCCCACCATGCGCGAGGGACAAGCTTACCCCGCTAATGTTCCCTACCCACTAATAG
GCAAAACCGCGGTTGATAGTATTACCCAGAAAAAGTTTCTTTGCGACCGCACCCTGTGGCGCATCCCCTT
CTCCAGTAACTTTATGTCCATGGGTGCGCTCACAGACCTGGGCCAAAACCTTCTCTACGCAAACTCCGCC
CACGCGCTAGACATGACCTTTGAGGTGGATCCCATGGACGAGCCCACCCTTCTTTATGTTTTGTTTGAAG
TCTTTGACGTGGTCCGTGTGCACCAGCCGCACCGCGGCGTCATCGAGACCGTGTACCTGCGCACGCCCTT
CTCGGCCGGCAACGCCACAACATAAAGAAGCAAGCAACATCAACAACAGCTGCCGCCATGGGCTCCAGTG
AGCAGGAACTGAAAGCCATTGTCAAAGATCTTGGTTGTGGGCCATATTTTTGGGCACCTATGACAAGCG
CTTCCCAGGCTTTGTTTCCCCACACAAGCTCGCCTGCGCCATAGTTAACACGGCCGGTCGCGAGACTGGG
GGCGTACACTGGATGGCCTTTGCCTGGAACCCGCGCTCAAAAACATGCTACCTCTTTGAGCCCTTTGGCT
TTTCTGACCAACGTCTCAAGCAGGTTTACCAGTTTGAGTACGAGTCACTCCTGCGCCGTAGCGCCATTGC
CTCTTCCCCCGACCGCTGTATAACGCTGGAAAAGTCCACCCAAAGCGTGCAGGGGCCCAACTCGGCCGCC
TGTGGCCTATTCTGCTGCATGTTTCTCCACGCCTTTGCCAACTGGCCCCAAACTCCCATGGATCACAACC
CCACCATGAACCTTATTACCGGGGTACCCAACTCCATGCTTAACAGTCCCCAGGTACAGCCCACCCTGCG
CCGCAACCAGGAACAGCTCTACAGCTTCCTGGAGCGCCACTCGCCCTACTTCCGCAGCCACAGTGCGCAA
ATTAGGAGCGCCACTTCTTTTTGTCACTTGAAAAACATGTAAAAATAATGTACTAGGAGACACTTTCAAT
AAAGGCAAATGTTTTATTTGTACACTCTCGGGTGATTATTTACCCCCACCCTTGCCGTCTGCGCCGTTT
AAAAATCAAAGGGGTTCTGCCGCGCATCGCTATGCGCCACTGGCAGGGACACGTTGCGATACTGGTGTTT
AGTGCTCCACTTAAACTCAGGCACAACCATCCGCGGCAGCTCGGTGAAGTTTTCACTCCACAGGCTGCGC
ACCATCACCAACGCGTTTAGCAGGTCGGGCGCCGATATCTTGAAGTCGCAGTTGGGGCCTCCGCCCTGCG
CGCGCGAGTTGCGATACACAGGGTTACAGCACTGGAACACTATCAGCGCCGGGTGGTGCACGCTGGCCAG
CACGCTCTTGTCGGAGATCANATCCGCGTCCAGGTCCTCCGCGTTGCTCAGGGCGAACGGAGTCAACTTT
GGTAGCTGCCTTCCCAAAAAGGGTGCATGCCCAGGCTTTGAGTTGCACTCGCACCGTAGTGGCATCAGAA
GGTGACCGTGCCCAGTCTGGGCGTTAGGATACAGCGCCTGCATGAAAGCCTTGATCTGCTTAAAAGCCAC
CTGAGCCTTTGCGCCTTCAGAGAAGAACATGCCGCAAGACTTGCCGGAAAACTGATTGGCCGGACAGGCC
GCGTCATGCACGCAGCACCTTGCGTCGGTGTTGGAGATCTGCACCACATTTCGGCCCCACCGGTTCTTCA
CGATCTTGGCCTTGCTAGACTGCTCCTTCAGCGCGCGCTGCCCGTTTTCGCTCGTCACATCCATTTCAAT
CACGTGCTCCTTATTTATCATAATGCTCCCGTGTAGACACTTAAGCTCGCCTTCGATCTCAGCGCAGCGG
```

FIG. 51 (continued)

SEQ ID NO:26 (continued)

```
TGCAGCCACAACGCGCAGCCCGTGGGCTCGTGGTGCTTGTAGGTTACCTCTGCAAACGACTGCAGGTACG
CCTGCAGGAATCGCCCCATCATCGTCACAAAGGTCTTGTTGCTGGTGAAGGTCAGCTGCAACCCGCGGTG
CTCCTCGTTTAGCCAGGTCTTGCATACGGCCGCCAGAGCTTCCACTTGGTCAGGCAGTAGCTTGAAGTTT
GCCTTTAGATCGTTATCCACGTGGTACTTGTCCATCAACGCGCGCAGCCTCCATGCCCTTCTCCCACG
CAGACACGATCGGCAGGCTCAGCGGGTTTATCACCGTGCTTTCACTTTCCGCTTCACTGGACTCTTCCTT
TTCCTCTTGCATCCGCATACCCGCGCCACTGGGTCGTCTTCATTCAGCCGCCGCACCGTGCGCTTACCT
CCCTTGCCGTGCTTGATTAGCACCGGTGGGTTGCTGAAACCCACCATTTGTAGCGCCACATCTTCTCTTT
CTTCCTCGCTGTCCACGATCACCTCTGGGGATGGCGGGCGCTCGGGCTTGGGAGAGGGGCGCTTCTTTTT
CTTTTTGGACGCAATGGCCAAATCCGCCGTCGAGGTCGATGGCCGCGGGCTGGGTGTGCGCGGCACCAGC
GCATCTTGTGACGAGTCTTCTTCGTCCTCGGACTCGAGACGCCGCCTCAGCCGCTTTTTTGGGGCGCGC
GGGGAGGCGGCGGCGACGGCGACGGGGACGAGACGTCCTCCATGGTTGGTGGACGTCGCGCCGCACCGCG
TCCGCGCTCGGGGGTGGTTTCGCGCTGCTCCTCTTCCCGACTGGCCATTTCCTTCTCCTATAGGCAGAAA
AAGATCATGGAGTCAGTCGAGAAGGAGGACAGCCTAACCGCCCCCTTTGAGTTCGCCACCACCGCCTCCA
CCGATGCCGCCAACGCGCCTACCACCTTCCCCGTCGAGGCACCCCGCTTGAGGAGGAGGAAGTGATTAT
CGAGCAGGACCCAGGTTTTGTAAGCGAAGACGACGAAGATCGCTCAGTACCAACAGAGGATAAAAGCAA
GACCAGGACGACGCAGAGGCAAACGAGGAACAAGTCGGGCGGGGGACCAAAGGCATGGCGACTACCTAG
ATGTGGGAGACGACGTGCTGTTGAAGCATCTGCAGCGCCAGTGCGCCATTATCTGCGACGCGTTGCAAGA
GCGCAGCGATGTGCCCCTCGCCATAGCGGATGTCAGCCTTGCCTACGAACGCCACCTGTTCTCACCGCGC
GTACCCCCAAACGCCAAGAAAACGGCACATGCGAGCCCAACCCGCGCCTCAACTTCTACCCCGTATTTG
CCGTGCCAGAGGTGCTTGCCACCTATCACATCTTTTTCCAAAACTGCAAGATACCCCTATCCTGCCGTGC
CAACCGCAGCCGAGCGGACAAGCAGCTGGCCTTGCGGCAGGGCGCTGTCATACCTGATATCGCCTCGCTC
GACGAAGTGCCAAAAATCTTTGAGGGTCTTGGACGCGACGAGAAGCGCGCGGCAAACGCTCTGCAACAAG
AAAACAGCGAAAATGAAAGTCACTGTGGAGTGCTGGTGGAACTTGAGGGTGACAACGCGCGCCTAGCCGT
GCTGAAACGCAGCATCGAGGTCACCCACTTTGCCTACCCGGCACTTAACCTACCCCCAAGGTTATGAGC
ACAGTCATGAGCGAGCTGATCGTGCGCCGTGCACGACCCCTGGAGAGGGATGCAAACTTGCAAGAACAAA
CCGAGGAGGGCCTACCCGCAGTTGGCGATGAGCAGCTGGCGCGCTGGCTTGAGACGCGCGAGCCTGCCGA
CTTGGAGGAGCGACGCAAGCTAATGATGGCCGCAGTGCTTGTTACCGTGGAGCTTGAGTGCATGCAGCGG
TTCTTTGCTGACCCGGAGATGCAGCGCAAGCTAGAGGAAACGTTGCACTACACCTTTCGCCAGGGCTACG
TGCGCCAGGCCTGCAAAATTTCCAACGTGGAGCTCTGCAACCTGGTCTCCTACCTTGGAATTTTGCACGA
AAACCGCCTTGGGCAAAACGTGCTTCATTCCACGCTCAAGGGCGAGGCGCGCCGCGACTACGTCCGCGAC
TGCGTTTACTTATTTCTGTGCTACACCTGGCAAACGGCCATGGGCGTGTGGCAGCAGTGCCTGGAGGAGC
GCAACCTGAAGGAGCTGCAGAAGCTGCTAAAGCAAACTTGAAGGACCTATGGACGGCCTTCAACGAGCG
CTCCGTGGCCGCGCACCTGGCGGACATTATCTTCCCCGAACGCCTGCTTAAAACCCTGCAACAGGGTCTG
CCAGACTTCACCAGTCAAAGCATGTTGCAAAACTTTAGGAACTTTATCCTAGAGCGTTCAGGAATTCTGC
CCGCCACCTGCTGTGCGCTTCCTAGCGACTTTGTGCCCATTAAGTACCGTGAATGCCCTCCGCCGCTTTG
GGGTCACTGCTACCTTNTGCAGCTAGCCAACTACCTTGCCTACCACTCCGACATCATGGAAGACGTGAGC
GGTGACGGCCTACTGGAGTGTCACTGTCGCTGCAACCTATGCACCCGCACCGCTCCCTGGTCTGCAATT
CACAACTGCTTAGCGAAAGTCAAATTATCGGTACCTTTGAGCTGCAGGGTCCCTCGCCTGACGAAAAGTC
CGCGGCTCCGGGGTTGAAACTCACTCCGGGGCTGTGGACGTCGGCTTACCTTCGCAAATTTGTACCTGAG
GACTACCACGCCCACGAGATTAGGTTCTACGAAGACCAATCCCGCCCGCCAAATGCGGAGCTTACCGCCT
GCGTCATTACCCAGGGCACATCCTTGGCCAATTGCAAGCCATTAACAAAGCCCGCCAAGAGTTTCTGCT
ACGAAAGGGACGGGGGGTTTACTTGGACCCCAGTCCGGCGAGGAGCTCAACCCAATCCCCCCGCCGCCG
CAGCCCTATCAGCAGCCGCGGGCCCTTGCTTCCCAGGATGGCACCCAAAAAGAAGCTGCAGCTGCCGCCG
CCGCCACCCACGGACGAGGAGGAATACTGGGACAGTCAGGCAGAGGAGGTTTTGGACGAGGAGGAGGAGA
TGATGGAAGACTGGGACAGCCTAGACGAGGAAGCTTCCGAGGCCGAAGAGGTGTCAGACGAAACACCGTC
ACCCTCGGTCGCATTCCCTCGCCGGCGCCCCAGAAATCGGCAACCGTTCCAGCATTGCTACAACCTCC
GCTCCTCAGGCGCCGCCGGCACTGCCCGTTCGCCGACCCAACCGTAGATGGGACACCACTGGAACCAGGG
CCGGTAAGTCTAAGCAGCCGCCGCCGTTAGCCCAAGAGCAACAACAGCGCCAAGGCTACCGCTCGTGGCG
CGTGCACAAGAACGCCATAGTTGCTTGCTTGCAAGACTGTGGGGCAACATCTCCTTCGCCCGCCGCTTT
CTTCTCTACCATCACGGCGTGGCCTTCCCCCGTAACATCCTGCATTACTACCGTCATCTCTACAGCCCCT
ACTGCACCGGCGGCAGCGGCAGCAACAGCAGCGGCCACGCAGAAGCAAAGGCGACCGGATAGCAAGACTC
TGACAAAGCCCAAGAAATCCACAGCGGCGGCAGCAGCAGGAGGAGGAGCACTGCGTCTGGCGCCCAACGA
```

SEQ ID NO:26 (continued)

```
ACCCGTATCGACCCGCGAGCTTAGAAACAGGATTTTTCCCACTCTGTATGCTATATTTCAACAGAGCAGG
GGCCAAGAACAAGAGCTGAAAATAAAAAACAGGTCTCTGCGCTCCCTCACCCGCAGCTGCCTGTATCACA
AAAGCGAAGATCAGCTTCGGCGCACGCTGGAAGACGCGGAGGCTCTCTTCAGCAAATACTGCGCGCTGAC
TCTTAAGGACTAGTTTCGCGCCCTTTCTCAAATTTAAGCGCGAAAACTACGTCATCTCCAGCGGCCACAC
CCGGCGCCAGCACCTGTCGTCAGCGCCATTATGAGCAAGGAAATTCCCACGCCCTACATGTGGAGTTACC
AGCCACAAATGGGACTTGCGGCTGGAGCTGCCCAAGACTACTCAACCCGAATAAACTACATGAGCGCGGG
ACCCCACATGATATCCCGGGTCAACGGAATCCGCGCCCACCGAAACCGAATTCTCCTCGAACAGGCGGCT
ATTACCACCACACCTCGTAATAACCTTAATCCCCGTAGTTGGCCCGCTGCCCTGGTGTACCAGGAAAGTC
CCGCTCCCACCACTGTGGTACTTCCCAGAGACGCCCAGGCCGAAGTTCAGATGACTAACTCAGGGGCGCA
GCTTGCGGGCGGCTTTCGTCACAGGGTGCGGTCGCCCGGGCAGGGTATAACTCACCTGAAAATCAGAGGG
CGAGGTATTCAGCTCAACGACGAGTCGGTGAGCTCCTCTCTTGGTCTCCGTCCGGACGGGACATTTCAGA
TCGGCGGCGCTGGCCGCTCTTCATTTACGCCCCGTCAGGCGATCCTAACTCTGCAGACCTCGTCCTCGGA
GCCGCGCTCCGGAGGCATTGGAACTCTACAATTTATTGAGGAGTTCGTGCCTTCGGTTTACTTCAACCCC
TTTTCTGGACCTCCCGGCCACTACCCGGACCAGTTTATTCCCAACTTTGACGCGGTAAAAGACTCGGCGG
ACGGCTACGACTGACAGATCTGAGCTCGCGGCCGCGATATCGCTAGCGAAGTTCCTATTCTCTAGAAAGT
ATAGGAACTTCGATCCTCTAGAGTCGACCTGCAGGCATGCAAGCTTGGCACTGCAATAAATTACTTACTT
AAAATCAGTCAGCAAATCTTTGTCCAGCTTATTCAGCATCACCTCCTTTCCCTCCTCCCAACTCTGGTAT
TTCAGCAGCCTTTTAGCTGCGAACTTTCTCCAAAGTCTAAATGGGATGTCAAATTCCTCATGTTCTTGTC
CCTCCGCACCCACTATCTTCATATTGTTGCAGATGAAACGCGCCAGACCGTCTGAAGACACCTTCAACCC
TGTGTACCCATATGACACGGAAACCGGCCCTCCAACTGTGCCTTTCCTTACCCCTCCCTTTGTGTCGCCA
AATGGGTTCCAAGAAAGTCCCCCCGGAGTGCTTTCTTTGCGTCTTTCAGAACCTTTGGTTACCTCACACG
GCATGCTTGCGCTAAAAATGGGCAGCGGCCTGTCCCTGGATCAGGCAGGCAACCTTACATCAAATACAAT
CACTGTTTCTCAACCGCTAAAAAAAACAAAGTCCAATATAACTTTGGAAACATCCGCGCCCCTTACAGTC
AGCTCAGGCGCCCTAACCATGGCCACAACTTCGCCTTTGGTGGTCTCTGACAACACTCTTACCATGCAAT
CACAAGCACCGCTAACCGTGCAAGACTCAAAACTTAGCATTGCTACCAAAGAGCCACTTACAGTGTTAGA
TGGAAAACTGGCCCTGCAGACATCAGCCCCCCTCTCTGCCACTGATAACAACGCCCTCACTATCACTGCC
TCACCTCCTCTTACTACTGCAAATGGTAGTCTGGCTGTTACCATGGAAAACCCACTTTACAACAACAATG
GAAAACTTGGGCTCAAAATTGGCGGTCCTTTGCAAGTGGCCACCGACTCACATGCACTAACACTAGGTAC
TGGTCAGGGGGTTGCAGTTCATAACAATTTGCTACATACAAAAGTTACAGGCGCAATAGGGTTTGATACA
TCTGGCAACATGGAACTTAAAACTGGAGATGGCCTCTATGTGGATAGCGCCGGTCCTAACCAAAAACTAC
ATATTAATCTAAATACCACAAAAGGCCTTGCTTTTGACAACACCGCAATAACAATTAACGCTGGAAAAGG
GTTGGAATTTGAAACAGACTCCTCAAACGGAAATCCCATAAAAACAAAAATTGGATCAGGCATACAATAT
AATACCAATGGAGCTATGGTTGCAAAACTTGGAACAGGCCTCAGTTTTGACAGCTCCGGAGCCATAACAA
TGGGCAGCATAAACAATGACAGACTTACTCTTTGGACAACACCAGACCCATCCCCAAATTGCAGAATTGC
TTCAGATAAAGACTGCAAGCTAACTCTGGCGCTAACAAAATGTGGCAGTCAAATTTTGGGCACTGTTTCA
GCTTTGGCAGTATCAGGTAATATGGCCTCCATCAATGGAACTCTAAGCAGTGTAAACTTGGTTCTTAGAT
TTGATGACAACGGAGTGCTTATGTCAAATTCATCACTGGACAAACAGTATTGGAACTTTAGAAACGGGGA
CTCCACTAACGGTCAACCATACACTTATGCTGTTGGGTTTATGCCAAACCTAAAAGCTTACCCAAAAACT
CAAAGTAAAACTGCAAAAAGTAATATTGTTAGCCAGGTGTATCTTAATGGTGACAAGTCTAAACCATTGC
ATTTTACTATTACGCTAAATGGAACAGATGAAACCAACCAAGTAAGCAAATACTCAATATCATTCAGTTG
GTCCTGGAACAGTGGACAATACACTAATGACAAATTTGCCACCAATTCCTATACCTTCTCCTACATTGCC
CAGGAATAAAGAATCGTGAACCTGTTGCATGTTATGTTTCAACGTGTTTATTTTCAATTCGTATTAGTC
ATCGCTATTACCATGGTGATGCGGTTTTGGCAGTACATCAATGGGCGTGGATAGCGGTTTGACTCACGGG
GATTTCCAAGTCTCCACCCCATTGACGTCAATGGGAGTTTGTTTTGGCACCAAAATCAACGGGACTTTCC
AAAATGTCGTAACAACTCCGCCCCATTGACGCAAATGGGCGGTAGGCGTGTACGGTGGGAGGTCTATATA
AGCAGAGCTGGTTTAGTGAACCGTCAGATCCGCTAGAGATCCACCATGTTTGTCTTTCTCGTGCTGCTGC
CCCTCGTGAGCAGCCAGTGCGTCAATCTGACAACAAGGACCCAGCTGCCCCCGCCTACACCAACTCCTT
CACAAGAGGCGTGTATTACCCCGATAAGGTCTTCAGATCCAGCGTCCTCCACAGCACCCAAGATTTGTTT
CTGCCTTTCTTCAGCAACGTGACATGGTTCCACGCCATTCATGTCAGCGGCACAAACGGCACAAGAGGT
TTGACAACCCCGTGCTCCCTTAACGACGGCGTGTACTTCGCCAGCACAGAGAAATCCAATATCATTAG
GGGCTGGATCTTCGGCACAACACTGGATTCCAAGACCCAGTCTCTGCTCATTGTGAATAACGCCACCAAC
GTGGTGATTAAGGTCTGTGAGTTTCAGTTCTGCAACGACCCCTTTCTGGGAGTCTACTACCACAAGAATA
```

FIG. 51 (continued)

SEQ ID NO:26 (continued)

```
ATAAGAGCTGGATGGAGTCCGAGTTTAGGGTGTACAGCTCCGCCAACAACTGTACCTTCGAATACGTGTC
CCAGCCTTTCCTCATGGATCTGGAGGGCAAGCAAGGCAATTTCAAAAATCTGAGAGAGTTCGTGTTCAAA
AACATTGATGGATACTTCAAAATCTACAGCAAGCATACCCCATTAATCTGGTGAGGGATCTGCCCCAAG
GATTCTCCGCTCTGGAACCTCTGGTGGATCTGCCCATTGGCATTAACATCACAAGATTCCAGACCCTCCT
CGCCCTCCATAGATCCTATCTGACCCCCGGCGACTCCTCCAGCGGATGGACAGCCGGAGCTGCCGCCTAC
TACGTGGGCTATCTGCAGCCAAGAACCTTTCTGCTGAAGTACAACGAGAACGGCACCATCACAGACGCTG
TCGATTGCGCTCTCGACCCTCTGAGCGAGACCAAATGCACACTGAAGAGCTTCACCGTGGAAAAGGGCAT
CTATCAGACCAGCAACTTCAGAGTGCAGCCTACCGAGAGCATTGTGAGGTTTCCCAACATCACCAATCTG
TGTCCTTTCGGCGAGGTCTTTAATGCCACAAGGTTCGCTTCCGTGTATGCTTGGAATAGGAAGAGGATCA
GCAATTGCGTCGCCGACTATTCCGTCCTCTATAACAGCGCCTCCTTCTCCACCTTCAAATGTTATGGCGT
GTCCCCCACCAAGCTCAACGACCTCTGCTTCACCAATGTGTACGCTGACTCCTTCGTCATTAGGGGCGAC
GAGGTGAGGCAAATTGCCCCGGCCAGACCGGCAAGATTGCTGATTACAACTACAAACTGCCCGACGATT
TTACCGGCTGCGTGATCGCTTGGAACTCCAACAATCTGGACTCCAAAGTGGGCGGAAACTACAATTACCT
CTACAGACTCTTTAGAAAAGCAATCTGAAGCCCTTCGAGAGAGACATCTCCACCGAAATCTACCAAGCC
GGAAGCACACCTTGCAATGGCGTCGAGGGATTTAACTGCTACTTCCCTCTGCAGAGCTACGGCTTTCAAC
CTACCAACGGCGTCGGATATCAACCCTATAGGGTGGTCGTGCTGAGCTTTGAACTGCTGCATGCTCCCGC
CACCGTCTGCGGACCTAAGAAGAGCACCAATCTCGTCAAAAACAAGTGCGTGAACTTCAACTTCAATGGA
CTGACCGGCACCGGCGTGCTGACCGAGAGCAATAAGAAGTTTCTGCCCTTCCAGCAGTTCGGAAGGGATA
TTGCCGATACCACAGATGCTGTGAGGGACCCCCAAACCCTCGAGATTCTGGATATCACCCCTTGCAGCTT
CGGAGGAGTGTCCGTGATCACCCCCGGAACAAACACCTCCAATCAAGTGGCTGTGCTGTACCAAGACGTG
AACTGCACAGAAGTCCCCGTGGCCATCCATGCCGACCAGCTGACCCCTACATGGAGAGTGTACTCCACCG
GCAGCAATGTGTTCCAGACAAGAGCCGGATGCCTCATTGGAGCTGAACACGTCAACAACAGCTACGAGTG
CGACATTCCCATCGGCGCCGGCATTTGTGCCTCCTATCAGACCCAGACCAACAGCCCAAGAAGGGCTAGA
AGCGTCGCTTCCCAATCCATCATTGCCTACACCATGTCTCTGGGAGCCGAAAACTCCGTCGCCTACTCCA
ACAATAGCATCGCCATCCCCACCAATTTTACCATCTCCGTGACCACAGAGATTCTGCCCGTGTCCATGAC
AAAGACATCCGTGGACTGCACCATGTACATCTGTGGCGACAGCACCGAGTGTAGCAATCTGCTGCTGCAA
TATGGCAGCTTCTGCACCCAGCTGAACAGAGCCCTCACCGGCATCGCCGTCGAACAAGACAAGAACACCC
AAGAGGTGTTCGCCCAAGTGAAGCAAATCTACAAGACCCCCCCTATCAAAGATTTCGGAGGATTCAACTT
TAGCCAGATTCTGCCCGATCCTAGCAAGCCTTCCAAGAGGAGCTTCATCGAGGATCTGCTGTTTAATAAG
GTGACACTGGCCGACGCTGGCTTCATTAAACAGTACGGCGATTGTCTGGGCGACATCGCTGCTAGGGATC
TGATCTGCGCTCAGAAGTTCAACGGACTGACAGTCCTCCCTCCTCTGCTGACCGACGAGATGATCGCTCA
GTATACCAGCGCTCTGCTGGCTGGAACCATTACCAGCGGCTGGACATTCGGCGCTGGAGCCGCCCTCCAA
ATTCCCTTTGCCATGCAGATGGCCTATAGATTCAACGGCATTGGCGTCACCCAAAATGTGCTGTATGAAA
ATCAGAAGCTGATTGCTAACCAATTCAATAGCGCCATTGGCAAGATCCAAGACTCTCTGAGCTCCACAGC
CAGCGCCCTCGGAAAGCTGCAAGACGTGGTGAATCAAAACGCCCAAGCTCTGAACACACTGGTGAAACAG
CTCAGCAGCAACTTTGGAGCCATCAGCAGCGTGCTCAATGATATCCTCTCTAGGCTGGACAAAGTGGAGG
CCGAAGTCCAGATCGATAGACTCATCACCGGCAGACTCCAATCTCTGCAGACATACGTCACCCAACAGCT
CATTAGAGCTGCCGAAATCAGAGCCTCCGCCAATCTGGCCGCCACCAAGATGTCCGAGTGCGTGCTGGGA
CAGAGCAAGAGAGTGGACTTCTGTGGCAAGGGATACCATCTGATGAGCTTCCCCCAGAGCGCTCCCCATG
GAGTGGTCTTTCTGCATGTCACATACGTGCCCGCCCAAGAGAAGAACTTCACCACCGCTCCCGCCATTTG
CCACGATGGAAAGGCCCACTTTCCCAGAGAAGGAGTGTTCGTGAGCAACGGCACACTGGTTTGTCACC
CAGAGAAATTTTTACGAGCCCCAGATTATCACCACCGACAACACCTTCGTGTCCGGAAACTGCGATGTCG
TGATTGGCATCGTGAACAACACAGTCTACGACCCTCTGCAGCCCGAACTCGACAGCTTCAAGGAAGAGCT
GGACAAGTACTTCAAGAATCACACATCCCCCGACGTGGATCTGGGCGACATTAGCGGCATTAATGCCTCC
GTCGTCAACATTCAGAAGGAGATTGATAGACTGAATGAAGTCGCCAAGAACCTCAATGAGTCTCTGATTG
ATCTGCAAGAGCTGGGCAAGTACGAGCAATACATCAAATGGCCTTGGTACATCTGGCTGGGATTCATCGC
TGGACTCATCGCCATCGTGATGGTCACCATTATGCTGTGTTGCATGACCAGCTGCTGCAGCTGTCTGAAG
GGCTGCTGCAGCTGCGGAAGCTGCTGCAAGTTTGACGAAGACGACTCCGAGCCCGTGCTGAAGGGCGTCA
AGCTGCATTATACATAAACTAGTGCTGGAATTCGCCCTTATAGAGTGCTGGAATTCGCCCTTATAGAGTG
CTGGAATTCGCCCTTATATCTAGTAACGGCCGCCAGTGTGCTGGAATTCGCCCTTATAACTTCGTATAGC
ATACATTATACGAAGTTATTGTTGACAATTAATCATCGGCATAGTATATCGGCATAGTATAATACGACAA
GGTGAGGAACTAAACCATGGCCAAGTTGACCAGTGCCGTTCCGGTGCTCACCGCGCGCGACGTCGCCGGA
```

FIG. 51 (continued)

SEQ ID NO:26 (continued)

```
GCGGTCGAGTTCTGGACCGACCGGCTCGGGTTCTCCCGGGACTTCGTGGAGGACGACTTCGCCGGTGTGG
TCCGGGACGACGTGACCCTGTTCATCAGCGCGGTCCAGGACCAGGTGGTGCCGGACAACACCCTGGCCTG
GGTGTGGGTGCGCGGCCTGGACGAGCTGTACGCCGAGTGGTCGGAGGTCGTGTCCACGAACTTCCGGGAC
GCCTCCGGGCCGGCCATGACCGAGATCGGCGAGCAGCCGTGGGGCGGGAGTTCGCCCTGCGCGACCCGG
CCGGCAACTGCGTGCACTTCGTGGCCGAGGAGCAGGACTGAATAACTTCGTATAGCATACATTATACGAA
GTTATAAGGGCGAATTCTGCAGATATCCATCCTTTAAAAAACCTCCCACACCTCCCCCTGAACCTGAAAC
ATAAAATGAATGCAATTGTTGTTGTTAACTTGTTTATTGCAGCTTATAATGGTTACAAATAAAGCAATAG
CATCACAAATTTCACAAATAAAGCATTTTTTTCACTGCATTCTAGTTGTGGTTTGTCCAAACTCATCAAT
GTATCTTAACAACGTGTTTATTTTTCAATTGCAGAAAGAATTGCAGAAAATTTCAAGTCATTTTTCATTC
AGTAGTATAGCCCCACCACCACATAGCTTATACTAATCACCGTACCTTAATCAAACTCACAGAACCCTAG
TATTCAACCTGCCACCTCCCTCCCAACACACAGAGTACACAGTCCTTTCTCCCGGCTGGCCTTAAACAG
CATCATATCATGGGTAACAGACATATTCTTAGGTGTTATATTCCACACGGTCTCCTGTCGAGCCAAACGC
TCATCAGTGATGTTAATAAACTCCCCGGGCAGCTCGCTTAAGTTCATGTCGCTGTCCAGCTGCTGAGCCA
CAGGCTGCTGTCCAACTTGCGGTTGCTCAACGGGCGGCGAAGGAGAAGTCCACGCCTACATGGGGGTAGA
GTCATAATCGTGCATCAGGATAGGGCGGTGGTGCTGCAGCAGCGCGCGAATAAACTGCTGCCGCCGCCGC
TCCGTCCTGCAGGAATACAACATGGCAGTGGTCTCCTCAGCGATGATTCGCACCGCCCGCAGCATAAGGC
GCCTTGTCCTCCGGGCACAGCAGCGCACCCTGATCTCACTTAAGTCAGCACAGTAACTGCAGCACAGTAC
CACAATATTGTTTAAAATCCCACAGTGCAAGGCGCTGTATCCAAAGCTCATGGCGGGGACCACAGAACCC
ACGTGGCCATCATACCACAAGCGCAGGTAGATTAAGTGGCGACCCCTCATAAACACGCTGGACATAAACA
TTACCTCTTTTGGCATGTTGTAATTCACCACCTCCCGGTACCATATAAACCTCTGATTAAACATGGCGCC
ATCCACCACCATCCTAAACCAGCTGGCCAAAACCTGCCCGCCGGCTATGCACTGCAGGGAACCGGGACTG
GAACAATGACAGTGGAGAGCCCAGGACTCGTAACCATGGATCATCATGCTCGTCATGATATCAATGTTGG
CACAACACAGGCACACGTGCATACACTTCCTCAGGATTACAAGCTCCTCCCGCGTCAGAACCATATCCCA
GGGAACAACCCATTCCTGAATCAGCGTAAATCCCACACTGCAGGGAAGACCTCGCACGTAACTCACGTTG
TGCATTGTCAAAGTGTTACATTCGGGCAGCAGCGGATGATCCTCCAGTATGGTAGCGCGTGTCTCTGTCT
CAAAAGGAGGTAGGCGATCCCTACTGTACGGAGTGCGCCGAGACAACCGAGATCGTGTTGGTCGTAGTGT
CATGCCAAATGGAACGCCGGACGTAGTCATATTTCCTGAAGCAAAACCAGGTGCGGGCGTGACAAACAGA
TCTGCGTCTCCGGTCTCGTCGCTTAGCTCGCTCTGTGTAGTAGTTGTAGTATATCCACTCTCTCAAAGCA
TCCAGGCGCCCCTGGCTTCGGGTTCTATGTAAACTCCTTCATGCGCCGCTGCCCTGATAACATCCACCA
CCGCAGAATAAGCCACACCCAGCCAACCTACACATTCGTTCTGCGAGTCACACACGGGAGGAGCGGGAAG
AGCTGGAAGAACCATGTTTTTTTTTTTATTCCAAAAGATTATCCAAAACCTCAAAATGAAGATCTATTA
AGTGAACGCGCTCCCCTCCGGTGGCGTGGTCAAACTCTACAGCCAAAGAACAGATAATGGCATTTGTAAG
ATGTTGCACAATGGCTTCCAAAAGGCAAACTGCCCTCACGTCCAAGTGGACGTAAAGGCTAAACCCTTCA
NGGTGAATCTCCTCTATAAACATTCCAGCACCTTCAACCATGCCCAAATAATTTTCATCTCGCCACCTTA
TCAATATGTCTCTAAGCAAATCCCGAATATTAAGTCCGGCCATTGTAAAAATCTGCTCCAGAGCGCCCTC
CACCTTCAGCCTCAAGCAGCGAATCATGATTGCAAAAATTCAGGTTCCTCACAGACCTGTATAAGATTCA
AAAGCGGAACATTAACAAAAATACCGCGATCCCGTAGGTCCCTTCGCAGGGCCAGCTGAACATAATCGTG
CAGGTCTGCACGGACCAGCGCGGCCACTTCCCCGCCAGGAACCATGACAAAAGAACCCACACTGATTATG
ACACGCATACTCGGAGCTATGCTAACCAGCGTAGCCCCGATGTAAGCTTGTTGCATGGGCGGCGATATAA
AATGCAAGGTACTGCTCAAAAAATCAGGCAAAGCCTCGCGCAAAAAGCAAGCACATCGTAGTCATGCTC
ATGCAGATAAAGGCAGGTAAGTTCCGGAACCACCACAGAAAAGACACCATTTTCTCTCAAACATGTCT
GCGGGTTCCTGCATAAACACAAAATAAAATAACAAAAAAAAAAAACATTTAAACATTAGAAGCCTGTCT
TACAACAGGAAAAACAACCCTTATAAGCATAAGACGGACTACGGCCATGCCGGCGTGACCGTAAAAAAAC
TGGTCACCGTGATTAAAAAGCACCACCGACAGTTCCTCGGTCATGTCCGGAGTCATAATGTAAGACTCGG
TAAACACATCAGGTTGGTTAACATCGGTCAGTGCTAAAAAGCGACCGAAATAGCCCGGGGAATACATAC
CCGCAGGCGTAGAGACAACATTACAGCCCCATAGGAGGTATAACAAAATTAATAGGAGAGAAAACACA
TAAACCCCTGAAAAACCCTCCTGCCCCTAGGCAAAATAGCACCCTCCCGCTCCAGAACAACATACAGCGC
TTCCACAGCGGCAGCCATAACAGTCAGCCTTACCAGTAAAAAACCTATTAAAAACACCACTCGACACG
GCACCAGCTCAATCAGTCACAGTGTAAAAAGGGCCAAGTACAGAGCGAGTATATATAGGACTAAAAAATG
ACGTAACGGTTAAAGTCCACAAAAACCACCCAGAAAACCGCACGCGAACCTACGCCCAGAAACGAAAGCC
AAAAAACCCACAACTTCCTCAAATCTTCACTTCCGTTTTCCCACGATACGTCACTTCCCATTTTAAAAAA
AAACTACAATTCCCAATACATGCAAGTTACTCCGCCCTAAAACCTACGTCACCCGCCCGTTCCCACGCC
```

FIG. 51 (continued)

SEQ ID NO:26 (continued)

CCGCGCCACGTCACAAACTCCACCCCCTCATTATCATATTGGCTTCAATCCAAAATAAGGTATATTATTG
ATGATGGCGAT

FIG. 51 (continued)

SEQ ID NO:27

```
CGCCATCATCAATAATATACCTTATTTTGGATTGAAGCCAATATGATAATGAGGGGGTGGAGTTTGTGAC
GTGGCGCGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTACGTGGAGACTCGCCCAGGTGTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGTAAAGAGGGAGCGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGTGGTTATTATGA
ATGTGAGGTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGGTGGTGTGTCGCCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC
GCACCAGGTGCAGACCCTGCGAGTGTGGCGGTAAACATATTAGGAACCAGCCTGTGATGCTGGATGTGAC
```

FIG. 52

SEQ ID NO:27 (continued)

```
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGGATATGAG
ATGCATCTTGGACTGTATTTTAGGTTGGCTATGTTCCAGCCATATCCCTCCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGGATCATGTCTACCTG
CGGGGCGATGAAGAAAACCGTTTCCGGGGTAGGGAGATCAGCTGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGCCACTTCGTTAAGCATGTCCCTGACTTGCATGTTTTCCCT
GACCAAATCCGCCAGAAGGCGCTCGCCGCCCAGCGATAGCAGTTCTTGCAAGGAAGCAAAGTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGGCGCCGCACGAGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCTGGTCAGAAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGACCCCATGGCATGGGTGGGTGAGCGCGGAGGCG
TACATGCCGCAAATGTCGTAAACGTAGAGGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
CGCGCAGCTTGTTGACCAGCTCGGCGGTGACCTGCACGTCTAGGGCGCAGTAGTCCAGGGTTTCCTTGAT
```

FIG. 52 (continued)

SEQ ID NO:27 (continued)

```
GATGTCATACTTATCCTGTCCCTTTTTTTTCCACAGCTCGCGGTTGAGGACAAACTCTTCGCGGTCTTTC
CAGTACTCTTGGATCGGAAACCCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAAGTCCGTGCGCTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCCGCGGCGCGACTACGGTACCGCGCGG
CGGGCGGTGGGCCGCGGGGGTGTCCTTGGATGATGCATCTAAAAGCGGTGACGCGGGCGGGCCCCGGAG
GTAGGGGGGCTCGGGACCCGCCGGGAGAGGGGGCAGGGCACGTCGGCGCCGCGCGGGCAGGAGCTG
GTGCTGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCCAAGGCCTCAAGGCGCTCCATGGCCTCGTAGAAGTCCACGG
CGAAGTTGAAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGGCCTCTTCTTCTTCTTCAATCTCCTCTTCCATA
AGGGCCTCCCCTTCTTCTTCTTCTGGCGGCGGTGGGGAGGGGGACACGGCGGCGACGACGGCGCACCG
GGAGGCGGTCGACAAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAGTGCGGCGGCGG
CTGGCGGTAGAGGGGCCAGCGTAGGGTGGCCGGGGCTCCGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
TAAATTCGCAAGGGTATCATGGCGGACGACCGGGGTTCGAACCCCGGATCCGGCCGTCCGCCGTGATCCA
```

FIG. 52 (continued)

SEQ ID NO:27 (continued)

```
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGTTTGACCCCGTCACTGGTCTTGTCATGCCTGGGGTATATA
CAAACGAAGCCTTCCATCCAGACATCATTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCCGGTGGTGGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTGGCGCGCCCGCCAGCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GGCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
ACACCCAGTGCGCGTGCGCGGGCACTACCGCGCGCCCTGGGGCGCGCACAAACGCGGCCGCACTGGGCGC
```

FIG. 52 (continued)

SEQ ID NO:27 (continued)

```
ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAAGAAGAGATGCTCCAGGTCATCGCGCCGGAGATCTA
TGGCCCCCCGAAGAAGGAAGAGCAGGATTACAAGCCCCGAAAGCTAAAGCGGGTCAAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCGAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCCGGCGTCCGCGCCGTTCAAGGAAGTACGGCGCCGCCAGCGCGCTACTGCCCGAATATGCCCT
ACATCCTTCCATCGCGCCTACCCCCGGCTATCGTGGCTACACCTACCGCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAAATAAAAGTCTGGACTCTCACGCTCGCTTGGTCCTGTAACTATTTT
GTAGAATGGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CCGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTTTGGGGGTGCAATCCCTGAAGCGCCGACGATGCTTCTGATAGCTAACGTGT
CGTATGTGTGTCATGTATGCGTCCATGTCGCCGCCAGAGGAGCTGCTGAGCCGCCGCGCGCCCGCTTTCC
AAGATGGCTACCCCTTCGATGATGCCGCAGTGGTCTTACATGCACATCTCGGGCCAGGACGCCTCGGAGT
ACCTGAGCCCCGGGCTGGTGCAGTTCGCCCCGCGCCACCGAGACGTACTTCAGCCTGAATAACAAGTTTAG
AAACCCCACGGTGGCGCCTACGCACGACGTGACCACAGACCGGTCTCAGCGTTTGACGCTGCGGTTCATC
CCCGTGGACCGCGAGGATACTGCGTACTCGTACAAGGCGCGGTTCACCCTAGCTGTGGGTGATAACCGTG
TGCTAGACATGGCTTCCACGTACTTTGACATCCGCGGCGTGCTGGACAGGGGCCCTACTTTTAAGCCCTA
CTCTGGCACTGCCTACAACGCACTGGCCCCAAGGGTGCCCCAACTCGTGCGAGTGGGAACAAAATGAA
ACTGCACAAGTGGATGCTCAAGAACTTGACGAAGAGGAGAATGAAGCCAATGAAGCTCAGGCGCGAGAAC
AGGAACAAGCTAAGAAAACCCATGTATATGCCCAGGCTCCACTGTCCGGAATAAAAATAACTAAAGAAGG
TCTACAAATAGGAACTGCCGACGCCACAGTAGCAGGTGCCGGCAAAGAAATTTTCGCAGACAAAACTTTT
CAACCTGAACCACAAGTAGGAGAATCTCAATGGAACGAAGCGGATGCCACAGCAGCTGGTGGAAGGGTTC
TTAAAAAGACAACTCCCATGAAACCCTGCTATGGCTCATACGCTAGACCCACCAATTCCAACGGCGGACA
GGGCGTTATGGTTGAACAAAATGGTAAATTGGAAAGTCAAGTCGAAATGCAATTTTTTTCCACATCCACA
```

FIG. 52 (continued)

SEQ ID NO:27 (continued)

```
AATGCCACAAATGAAGTTAACAATATACAACCAACAGTTGTATTGTACAGCGAAGATGTAAACATGGAAA
CTCCAGATACTCATCTTTCTTATAAACCTAAAATGGGGGATAAAAATGCCAAAGTCATGCTTGGACAACA
AGCAATGCCAAACAGACCAAATTACATTGCTTTTAGAGACAATTTTATTGGTCTCATGTATTACAACAGC
ACAGGTAACATGGGTGTCCTTGCTGGTCAGGCATCGCAGTTGAACGCTGTTGTAGATTTGCAAGACAGAA
ACACAGAGCTGTCCTACCAGCTTTTGCTTGATTCAATTGGCGACAGAACAAGATACTTTTCAATGTGGAA
TCAAGCTGTTGACAGCTATGATCCAGATGTCAGAATTATTGAGAACCATGGAACTGAGGATGAGTTGCCA
AATTATTGCTTTCCTCTTGGTGGAATTGGGATTACTGACACTTTTCAAGCTGTTAAAACAACTGCTGCTA
ACGGGGACCAAGGCAATACTACCTGGCAAAAAGATTCAACATTTGCAGAACGCAATGAAATAGGGGTGGG
AAATAACTTTGCCATGGAAATTAACCTGAATGCCAACCTATGGAGAAATTTCCTTTACTCCAATATTGCG
CTGTACCTGCCAGACAAGCTAAAATACAACCCCACCAATGTGGAAATATCTGACAACCCCAACACCTACG
ACTACATGAACAAGCGAGTGGTGGCTCCTGGGCTTGTAGACTGCTACATTAACCTTGGGGCGCGCTGGTC
TCTGGACTACATGGACAACGTTAATCCCTTTAACCACCCCGCCATGCGGGCCTGCGTTACCGCTCCATG
TTGTTGGGAAACGGCCGCTACGTGCCCTTTCACATTCAGGTGCCCCAAAAGTTTTTGCCATTAAAAACC
TCCTCCTCCTGCCAGGCTCATACACATATGAATGGAACTTCAGGAAGGATGTTAACATGGTTCTGCAGAG
CTCTCTGGGAAACGACCTTAGAGTTGACGGGGCTAGCATTAAGTTTGACAGCATTTGTCTTTACGCCACC
TTCTTCCCCATGGCCCACAACACGGCCTCCACGCTGGAAGCCATGCTCAGAAATGACACCAACGACCAGT
CCTTTAATGACTACCTTTCCGCCGCCAACATGCTATATCCCATACCCGCCAACGCCACCAACGTGCCCAT
CTCCATCCCATCGCGCAACTGGGCAGCATTTCGCGGTTGGGCCTTCACACGCTTGAAGACAAAGGAAACC
CCTTCCCTGGGATCAGGCTACGACCCTTACTACACCTACTCTGGCTCCATACCATACCTTGACGGAACCT
TCTATCTTAATCACACCTTTAAGAAGGTGGCCATTACTTTTGACTCTTCTGTTAGCTGGCCGGGCAACGA
CCGCCTGCTTACTCCCAATGAGTTTGAGATTAAGCGCTCAGTTGACGGGGAGGGCTATAACGTAGCTCAG
TGCAACATGACAAAGGACTGGTTCCTAGTGCAGATGTTGGCCAACTACAATATTGGCTACCAGGGCTTCT
ACATTCCAGAAAGCTACAAAGACCGCATGTACTCGTTCTTCAGAAACTTCCAGCCCATGAGCCGGCAAGT
GGTGGACGATACTAAATACAAAGATTATCAGCAGGTTGGAATTATCCACCAGCATAACAACTCAGGCTTC
GTAGGCTACCTCGCTCCCACCATGCGCGAGGGACAAGCTTACCCCGCTAATGTTCCCTACCCACTAATAG
GCAAAACCGCGGTTGATAGTATTACCCAGAAAAAGTTTCTTTGCGACCGCACCCTGTGGCGCATCCCCTT
CTCCAGTAACTTTATGTCCATGGGTGCGCTCACAGACCTGGGCCAAAACCTTCTCTACGCAAACTCCGCC
CACGCGCTAGACATGACCTTTGAGGTGGATCCCATGGACGAGCCCACCCTTCTTTATGTTTTGTTTGAAG
TCTTTGACGTGGTCCGTGTGCACCAGCCGCACCGCGGCGTCATCGAGACCGTGTACCTGCGCACGCCCTT
CTCGGCCGGCAACGCCACAACATAAAGAAGCAAGCAACATCAACAACAGCTGCCGCCATGGGCTCCAGTG
AGCAGGAACTGAAAGCCATTGTCAAAGATCTTGGTTGTGGGCCATATTTTTGGGCACCTATGACAAGCG
CTTCCCAGGCTTTGTTTCCCCACACAAGCTCGCCTGCGCCATAGTTAACACGGCCGGTCGCGAGACTGGG
GGCGTACACTGGATGGCCTTTGCCTGGAACCCGCGCTCAAAAACATGCTACCTCTTTGAGCCCTTTGGCT
TTTCTGACCAACGTCTCAAGCAGGTTTACCAGTTTGAGTACGAGTCACTCCTGCGCCGTAGCGCCATTGC
CTCTTCCCCCGACCGCTGTATAACGCTGGAAAAGTCCACCCAAAGCGTGCAGGGGCCCAACTCGGCCGCC
TGTGGCCTATTCTGCTGCATGTTTCTCCACGCCTTTGCCAACTGGCCCCAAACTCCCATGGATCACAACC
CCACCATGAACCTTATTACCGGGGTACCCAACTCCATGCTTAACAGTCCCCAGGTACAGCCCACCCTGCG
CCGCAACCAGGAACAGCTCTACAGCTTCCTGGAGCGCCACTCGCCCTACTTCCGCAGCCACAGTGCGCAA
ATTAGGAGCGCCACTTCTTTTTGTCACTTGAAAAACATGTAAAAATAATGTACTAGGAGACACTTTCAAT
AAAGGCAAATGTTTTATTTGTACACTCTCGGGTGATTATTTACCCCCACCCTTGCCGTCTGCGCCGTTT
AAAAATCAAAGGGGTTCTGCCGCGCATCGCTATGCGCCACTGGCAGGGACACGTTGCGATACTGGTGTTT
AGTGCTCCACTTAAACTCAGGCACAACCATCCGCGGCAGCTCGGTGAAGTTTTCACTCCACAGGCTGCGC
ACCATCACCAACGCGTTTAGCAGGTCGGGCGCCGATATCTTGAAGTCGCAGTTGGGCCTCCGCCCTGCG
CGCGCGAGTTGCGATACACAGGGTTACAGCACTGGAACACTATCAGCGCCGGGTGGTGCACGCTGGCCAG
CACGCTCTTGTCGGAGATCANATCCGCGTCCAGGTCCTCCGCGTTGCTCAGGGCAACGGAGTCAACTTT
GGTAGCTGCCTTCCCAAAAAGGGTGCATGCCCAGGCTTTGAGTTGCACTCGCACCGTAGTGGCATCAGAA
GGTGACCGTGCCCAGTCTGGGCGTTAGGATACAGCGCCTGCATGAAAGCCTTGATCTGCTTAAAAGCCAC
CTGAGCCTTTGCGCCTTCAGAGAAGAACATGCCGCAAGACTTGCCGGAAAACTGATTGGCCGGACAGGCC
GCGTCATGCACGCAGCACCTTGCGTCGGTGTTGGAGATCTGCACCACATTTCGGCCCCACCGGTTCTTCA
CGATCTTGGCCTTGCTAGACTGCTCCTTCAGCGCGCGCTGCCCGTTTTCGCTCGTCACATCCATTTCAAT
CACGTGCTCCTTATTTATCATAATGCTCCCGTGTAGACACTTAAGCTCGCCTTCGATCTCAGCGCAGCGG
TGCAGCCACAACGCGCAGCCCGTGGGCTCGTGGTGCTTGTAGGTTACCTCTGCAAACGACTGCAGGTACG
```

FIG. 52 (continued)

SEQ ID NO:27 (continued)

```
CCTGCAGGAATCGCCCCATCATCGTCACAAAGGTCTTGTTGCTGGTGAAGGTCAGCTGCAACCCGCGGTG
CTCCTCGTTTAGCCAGGTCTTGCATACGGCCGCCAGAGCTTCCACTTGGTCAGGCAGTAGCTTGAAGTTT
GCCTTTAGATCGTTATCCACGTGGTACTTGTCCATCAACGCGCGCGCAGCCTCCATGCCCTTCTCCCACG
CAGACACGATCGGCAGGCTCAGCGGGTTTATCACCGTGCTTTCACTTTCCGCTTCACTGGACTCTTCCTT
TTCCTCTTGCATCCGCATACCCCGCGCCACTGGGTCGTCTTCATTCAGCCGCCGCACCGTGCGCTTACCT
CCCTTGCCGTGCTTGATTAGCACCGGTGGGTTGCTGAAACCCACCATTTGTAGCGCCACATCTTCTCTTT
CTTCCTCGCTGTCCACGATCACCTCTGGGGATGGCGGGCGCTCGGGCTTGGGAGAGGGGCGCTTCTTTTT
CTTTTTGGACGCAATGGCCAAATCCGCCGTCGAGGTCGATGGCCGCGGGCTGGGTGTGCGCGGCACCAGC
GCATCTTGTGACGAGTCTTCTTCGTCCTCGGACTCGAGACGCCGCCTCAGCCGCTTTTTTGGGGCGCGC
GGGGAGGCGGCGGCGACGGCGACGGGGACGAGACGTCCTCCATGGTTGGTGGACGTCGCGCCGCACCGCG
TCCGCGCTCGGGGGTGGTTTCGCGCTGCTCCTCTTCCCGACTGGCCATTTCCTTCTCCTATAGGCAGAAA
AAGATCATGGAGTCAGTCGAGAAGGAGGACAGCCTAACCGCCCCCTTTGAGTTCGCCACCACCGCCTCCA
CCGATGCCGCCAACGCGCCTACCACCTTCCCCGTCGAGGCACCCCGCTTGAGGAGGAGGAAGTGATTAT
CGAGCAGGACCCAGGTTTTGTAAGCGAAGACGACGAAGATCGCTCAGTACCAACAGAGGATAAAAAGCAA
GACCAGGACGACGCAGAGGCAAACGAGGAACAAGTCGGGCGGGGGGACCAAAGGCATGGCGACTACCTAG
ATGTGGGAGACGACGTGCTGTTGAAGCATCTGCAGCGCCAGTGCGCCATTATCTGCGACGCGTTGCAAGA
GCGCAGCGATGTGCCCCTCGCCATAGCGGATGTCAGCCTTGCCTACGAACGCCACCTGTTCTCACCGCGC
GTACCCCCAAACGCCAAGAAAACGGCACATGCGAGCCCAACCCGCGCCTCAACTTCTACCCCGTATTTG
CCGTGCCAGAGGTGCTTGCCACCTATCACATCTTTTTCCAAAACTGCAAGATACCCCTATCCTGCCGTGC
CAACCGCAGCCGAGCGGACAAGCAGCTGGCCTTGCGGCAGGGCGCTGTCATACCTGATATCGCCTCGCTC
GACGAAGTGCCAAAAATCTTTGAGGGTCTTGGACGCGACGAGAAGCGCGCGGCAAACGCTCTGCAACAAG
AAAACAGCGAAAATGAAAGTCACTGTGGAGTGCTGGTGGAACTTGAGGGTGACAACGCGCGCCTAGCCGT
GCTGAAACGCAGCATCGAGGTCACCCACTTTGCCTACCCGGCACTTAACCTACCCCCAAGGTTATGAGC
ACAGTCATGAGCGAGCTGATCGTGCGCCGTGCACGACCCTGGAGAGGGATGCAAACTTGCAAGAACAAA
CCGAGGAGGGCCTACCCGCAGTTGGCGATGAGCAGCTGGCGCGCTGGCTTGAGACGCGCGAGCCTGCCGA
CTTGGAGGAGCGACGCAAGCTAATGATGGCCGCAGTGCTTGTTACCGTGGAGCTTGAGTGCATGCAGCGG
TTCTTTGCTGACCCGGAGATGCAGCGCAAGCTAGAGGAAACGTTGCACTACACCTTTCGCCAGGGCTACG
TGCGCCAGGCCTGCAAAATTTCCAACGTGGAGCTCTGCAACCTGGTCTCCTACCTTGGAATTTTGCACGA
AAACCGCCTTGGGCAAAACGTGCTTCATTCCACGCTCAAGGGCGAGGCGCGCCGCGACTACGTCCGCGAC
TGCGTTTACTTATTTCTGTGCTACACCTGGCAAACGGCCATGGGCGTGTGGCAGCAGTGCCTGGAGGAGC
GCAACCTGAAGGAGCTGCAGAAGCTGCTAAAGCAAAACTTGAAGGACCTATGGACGGCCTTCAACGAGCG
CTCCGTGGCCGCGCACCTGGCGGACATTATCTTCCCCGAACGCCTGCTTAAAACCCTGCAACAGGGTCTG
CCAGACTTCACCAGTCAAAGCATGTTGCAAAACTTTAGGAACTTTATCCTAGAGCGTTCAGGAATTCTGC
CCGCCACCTGCTGTGCGCTTCCTAGCGACTTTGTGCCCATTAAGTACCGTGAATGCCCTCCGCCGCTTTG
GGGTCACTGCTACCTTNTGCAGCTAGCCAACTACCTTGCCTACCACTCCGACATCATGGAAGACGTGAGC
GGTGACGGCCTACTGGAGTGTCACTGTCGCTGCAACCTATGCACCCCGCACCGCTCCCTGGTCTGCAATT
CACAACTGCTTAGCGAAAGTCAAATTATCGGTACCTTTGAGCTGCAGGGTCCCTCGCCTGACGAAAAGTC
CGCGGCTCCGGGGTTGAAACTCACTCCGGGGCTGTGGACGTCGGCTTACCTTCGCAAATTTGTACCTGAG
GACTACCACGCCCACGAGATTAGGTTCTACGAAGACCAATCCCGCCCGCCAAATGCGGAGCTTACCGCCT
GCGTCATTACCCAGGGCCACATCCTTGGCCAATTGCAAGCCATTAACAAAGCCCGCCAAGAGTTTCTGCT
ACGAAAGGGACGGGGGGTTTACTTGGACCCCCAGTCCGGCGAGGAGCTCAACCCAATCCCCCCGCCGCCG
CAGCCCTATCAGCAGCCGCGGGCCCTTGCTTCCCAGGATGGCACCCAAAAAGAAGCTGCAGCTGCCGCCG
CCGCCACCCACGGACGAGGAGGAATACTGGGACAGTCAGGCAGAGGAGGTTTTGGACGAGGAGGAGGAGA
TGATGGAAGACTGGGACAGCCTAGACGAGGAAGCTTCCGAGGCCGAAGAGGTGTCAGACGAAACACCGTC
ACCCTCGGTCGCATTCCCCTCGCCGGCGCCCCAGAAATCGGCAACCGTTCCCAGCATTGCTACAACCTCC
GCTCCTCAGGCGCCGCCGGCACTGCCCGTTCGCCGACCCAACCGTAGATGGGACACCACTGGAACCAGGG
CCGGTAAGTCTAAGCAGCCGCCGCCGTTAGCCCAAGAGCAACAACAGCGCCAAGGCTACCGCTCGTGGCG
CGTGCACAAGAACGCCATAGTTGCTTGCTTGCAAGACTGTGGGGGCAACATCTCCTTCGCCCGCCGCTTT
CTTCTCTACCATCACGGCGTGGCCTTCCCCCGTAACATCCTGCATTACTACCGTCATCTCTACAGCCCCT
ACTGCACCGGCGGCAGCGGCAGCAACAGCAGCGGCCACGCAGAAGCAAAGGCGACCGGATAGCAAGACTC
TGACAAAGCCCAAGAAATCCACAGCGGCGGCAGCAGCAGGAGGAGGAGCACTGCGTCTGGCGCCCAACGA
ACCCGTATCGACCCGCGAGCTTAGAAACAGGATTTTTCCCACTCTGTATGCTATATTTCAACAGAGCAGG
```

FIG. 52 (continued)

SEQ ID NO:27 (continued)

```
GGCCAAGAACAAGAGCTGAAAATAAAAAACAGGTCTCTGCGCTCCCTCACCCGCAGCTGCCTGTATCACA
AAAGCGAAGATCAGCTTCGGCGCACGCTGGAAGACGCGGAGGCTCTCTTCAGCAAATACTGCGCGCTGAC
TCTTAAGGACTAGTTTCGCGCCCTTTCTCAAATTTAAGCGCGAAAACTACGTCATCTCCAGCGGCCACAC
CCGGCGCCAGCACCTGTCGTCAGCGCCATTATGAGCAAGGAAATTCCCACGCCCTACATGTGGAGTTACC
AGCCACAAATGGGACTTGCGGCTGGAGCTGCCCAAGACTACTCAACCCGAATAAACTACATGAGCGCGGG
ACCCCACATGATATCCCGGGTCAACGGAATCCGCGCCCACCGAAACCGAATTCTCCTCGAACAGGCGGCT
ATTACCACCACACCTCGTAATAACCTTAATCCCCGTAGTTGGCCCGCTGCCCTGGTGTACCAGGAAAGTC
CCGCTCCCACCACTGTGGTACTTCCCAGAGACGCCCAGGCCGAAGTTCAGATGACTAACTCAGGGGCGCA
GCTTGCGGGCGGCTTTCGTCACAGGGTGCGGTCGCCCGGGCAGGGTATAACTCACCTGAAAATCAGAGGG
CGAGGTATTCAGCTCAACGACGAGTCGGTGAGCTCCTCTCTTGGTCTCCGTCCGGACGGGACATTTCAGA
TCGGCGGCGCTGGCCGCTCTTCATTTACGCCCCGTCAGGCGATCCTAACTCTGCAGACCTCGTCCTCGGA
GCCGCGCTCCGGAGGCATTGGAACTCTACAATTTATTGAGGAGTTCGTGCCTTCGGTTTACTTCAACCCC
TTTTCTGGACCTCCCGGCCACTACCCGGACCAGTTTATTCCCAACTTTGACGCGGTAAAAGACTCGGCGG
ACGGCTACGACTGACAGATCTGAGCTCGCGGCCGCGATATCGCTAGCGAAGTTCCTATTCTCTAGAAAGT
ATAGGAACTTCGATCCTCTAGAGTCGACCTGCAGGCATGCAAGCTTGGCACTGCAATAAATTACTTACTT
AAAATCAGTCAGCAAATCTTTGTCCAGCTTATTCAGCATCACCTCCTTTCCCTCCTCCCAACTCTGGTAT
TTCAGCAGCCTTTTAGCTGCGAACTTTCTCCAAAGTCTAAATGGGATGTCAAATTCCTCATGTTCTTGTC
CCTCCGCACCCACTATCTTCATATTGTTGCAGATGAAACGCGCCAGACCGTCTGAAGACACCTTCAACCC
TGTGTACCCATATGACACGGAAACCGGCCCTCCAACTGTGCCTTTCCTTACCCCTCCCTTTGTGTCGCCA
AATGGGTTCCAAGAAAGTCCCCCCGGAGTGCTTTCTTTGCGTCTTTCAGAACCTTTGGTTACCTCACACG
GCATGCTTGCGCTAAAAATGGGCAGCGGCCTGTCCCTGGATCAGGCAGGCAACCTTACATCAAATACAAT
CACTGTTTCTCAACCGCTAAAAAAACAAAGTCCAATATAACTTTGGAAACATCCGCGCCCCTTACAGTC
AGCTCAGGCGCCCTAACCATGGCCACAACTTCGCCTTTGGTGGTCTCTGACAACACTCTTACCATGCAAT
CACAAGCACCGCTAACCGTGCAAGACTCAAAACTTAGCATTGCTACCAAAGAGCCACTTACAGTGTTAGA
TGGAAAACTGGCCCTGCAGACATCAGCCCCCCTCTCTGCCACTGATAACAACGCCCTCACTATCACTGCC
TCACCTCCTCTTACTACTGCAAATGGTAGTCTGGCTGTTACCATGGAAAACCCACTTTACAACAACAATG
GAAAACTTGGGCTCAAAATTGGCGGTCCTTTGCAAGTGGCCACCGACTCACATGCACTAACACTAGGTAC
TGGTCAGGGGGTTGCAGTTCATAACAATTTGCTACATACAAAAGTTACAGGCGCAATAGGGTTTGATACA
TCTGGCAACATGGAACTTAAAACTGGAGATGGCCTCTATGTGGATAGCGCCGGTCCTAACCAAAAACTAC
ATATTAATCTAAATACCACAAAAGGCCTTGCTTTTGACAACACCGCAATAACAATTAACGCTGGAAAAGG
GTTGGAATTTGAAACAGACTCCTCAAACGGAAATCCCATAAAAACAAAAATTGGATCAGGCATACAATAT
AATACCAATGGAGCTATGGTTGCAAAACTTGGAACAGGCCTCAGTTTTGACAGCTCCGGAGCCATAACAA
TGGGCAGCATAAACAATGACAGACTTACTCTTTGGACAACACCAGACCCATCCCCAAATTGCAGAATTGC
TTCAGATAAAGACTGCAAGCTAACTCTGGCGCTAACAAAATGTGGCAGTCAAATTTTGGGCACTGTTTCA
GCTTTGGCAGTATCAGGTAATATGGCCTCCATCAATGGAACTCTAAGCAGTGTAAACTTGGTTCTTAGAT
TTGATGACAACGGAGTGCTTATGTCAAATTCATCACTGGACAAACAGTATTGGAACTTTAGAAACGGGGA
CTCCACTAACGGTCAACCATACACTTATGCTGTTGGGTTTATGCCAAACCTAAAAGCTTACCCAAAAACT
CAAAGTAAAACTGCAAAAAGTAATATTGTTAGCCAGGTGTATCTTAATGGTGACAAGTCTAAACCATTGC
ATTTTACTATTACGCTAAATGGAACAGATGAAACCAACCAAGTAAGCAAATACTCAATATCATTCAGTTG
GTCCTGGAACAGTGGACAATACACTAATGACAAATTTGCCACCAATTCCTATACCTTCTCCTACATTGCC
CAGGAATAAAGAATCGTGAACCTGTTGCATGTTATGTTTCAACGTGTTTATTTTTCAATTCGTATTAGTC
ATCGCTATTACCATGGTGATGCGGTTTTGGCAGTACATCAATGGGCGTGGATAGCGGTTTGACTCACGGG
GATTTCCAAGTCTCCACCCCATTGACGTCAATGGGAGTTTGTTTTGGCACCAAAATCAACGGGACTTTCC
AAAATGTCGTAACAACTCCGCCCCATTGACGCAAATGGGCGGTAGGCGTGTACGGTGGGAGGTCTATATA
AGCAGAGCTGGTTTAGTGAACCGTCAGATCCGCTAGAGATCTAACCGGTGGAAAGCGCTACCATGCCTTC
ATCCGTGTCATGGGGAATCCTGCTGCTGGCTGGACTGTGCTGTCTGGTGCCTGTCTCACTGGCCGAGGAC
CCTTTTAATCTGGTGACAGGCTGGCAGACTATCAATGGGAAGAAATACTATTTCGACATTAACACCGGCG
CCGCTCTGATCAGCTACAAGATCATTAACGGGAAACACTTCTACTTCAACAATGACGGAGTGATGCAGCT
GGGCGTCTTTAAGGGCCCCGATGGGTTCGAGTACTTCGCACCTGCCAATACACAGAACAATAACATTGAA
GGACAGGCCATCGTGTATCAGTCCAAATTCCTGACTCTGAACGGCAAGAAATACTATTTTGACCAGGATT
CTAAGGCCGTCACCGGGTGGCGAATCATTAATAACGAGAAGTACTACTTCAACCCCAATAACGCTATTGC
AGCCGTGGGCCTGCAGGTCATCGACAATAACAAGTACTATTTCAACCCTGATACTGCCATCATTTCCAAA
```

SEQ ID NO:27 (continued)

```
GGATGGCAGACCGTGCAGGGCTCTCGCTACTATTTCGACACCGATACAGCCATCGCCTTCAACGGGTACA
AGACCATCGACGGAAAACATTTCTATTTTGACTCAGATTGCGTGGTCAAGATCGGCGTGTTCAGCACCTC
CAACGGCTTCGAGTACTTTGCCCCAGCTAACACATACAACAACAACATCGAGGGCCAGGCCATCGTGTAC
CAGAGCAAGTTCCTGACCCTGAATGGCAAGAAATACTACTTCGACCAGAACTCTAAGGCAGTCACCGGGT
GGCAGACAATCGATAGTAAGAAGTACTACTTCAACACTAACACCGCCGAGGCTGCAACTGGCTGGCAGAC
CATCGACGGGAAGAAATATTATTTCAATACAAACACTGCCGAAGCCGCTACAGGATGGCAGACTATTGAC
GGCAAGAAATATTACTTCAACACCAACACAGCAATCGCCTCTACAGGGTACACTATCATTAATGGAAAGC
ACTTCTACTTCAACACTGATGGATCATGCAGATTGGAGTGTTCAAAGGACCAAATGGCTTCGAGTACTT
TGCTCCCGCAAACACAGACGCCAACAATATTGAGGGCCAGGCTATCCTGTATCAGAATGAATTCCTGACA
CTGAACGGCAAGAAATATTATTTTGGGTCTGATAGTAAGGCTGTGACTGGCTGGAGGATCATTAACAATA
AGAAGTACTATTTCAACCCCAACAACGCAATCGCAGCCATTCACCTGTGCACCATTAACAATGACAAGTA
CTACTTCAGCTACGACGGCATCCTGCAGAATGGGTATATCACAATTGAGCGCAACAATTTCTACTTTGAC
GCCAACCAGGAATCCAAGATGGTGACCGGCGTCTTCAAAGGGCCTAATGGATTTGAATATTCGCCCCAG
CTAACACACATAATAACAATATCGAGGGGCAGGCTATCGTGTATCAGAATAAGTTCCTGACCCTGAACGG
CAAGAAATACTACTTTGACCAGGATAGCAAAGCCGTGACCGGATGGCAGACAATCGATGGCAAGAAATAT
TATTTCAATCTGAACACAGCCGAGGCCGCAACTGGGTGGCAGACCATCGATGGAAAGAAATACTACTTCA
ACCTGAACACTGCTGAAGCCGCTACCGGATGGCAGACTATCGACGGGAAGAAATACTATTTCAATACTAA
CACCTTTATTGCCTCTACCGGATACACAAGTATCAATGGCAAGCACTTCTACTTCAACACGGATGGAATC
ATGCAGATTGGCGTGTTCAAAGGCCCCAACGGATTTGAATACTTTGCACCTGCCAACACTCATAATAACA
ATATTGAAGGCCAGGCTATCCTGTACCAAAATAAGTTCCTGACCCTGAACGGGAAGAAATATTACTTCGG
ATCAGACAGCAAAGCCGTGACCGGCCTGAGGACAATCGATGGGAAGAAATATTATTTCAATACGAACACT
GCTGTGGCAGTCACTGGATGGCAGACCATTAATGGCAAGAAATATTACTTCAACACGCAGACAAGCATCG
CCTCCACTGGGTACACCATCATTAGCGGAAAGCACTTCTACTTCAACACCGACGGCATTATGCAGATCGG
AGTGTTCAAAGGCCCTGATGGATTTGAGTACTTTGCCCCGCTAATACAGATGCAAATAACATTGAAGGC
CAGGCCATCCGATACCAGAACCGGTTCCTGTATCTGCATGACAATATCTACTATTTTGGCCAGAACTCCA
AGGCAGCCACAGGCTGGGTGACTATCGATGGGAATCGGTACTATTTCGAGCCTAATACAGCTATGGGGGC
AAACGGATACAAGACTATCGATAACAAGAACTTCTACTTCCGGAATGGCCTGCCTCAGATCGGGGTGTTT
AAGGGCAGCAACGGATTCGAGTACTTTGCACCAGCCAACACCGACGCCAATAATATTGAAGGCCAGGCAA
TCAGATACCAGAACAGGTTCCTGCATCTGCTGGGCAAAATCTACTACTTCGGCCAGAATTCCAAAGCAGT
GACTGGCTGGCAGACAATCAACGGAAAGGTCTACTACTTCATGCCTGACACAGCAATGGCTGCAGCCGGC
GGACTGTTCGAGATTGACGGCGTGATCTACTTCTTTGGAGTGGATGGCGTCAAAGCACCTGGAATCTACG
GAAGAGGACGGAGATCAAGAGGAAGGCGCAGCAACCTGATCACTGGATTCGTGACCGTCGGCGACGATAA
GTACTACTTCAACCCTATTAACGGAGGCGCTGCATCCATCGGCGAGACCATCATCGACGATAAGAACTAC
TACTTCCAGCAGAGTGGGGTGCTGCAGACAGGAGTCTTCTCAACTGAGGACGGCTTCAAGTACTTTGCTC
CAGCAAATACCCTGGATGAAAACCTGGAGGGAGAAGCCATTGACTTTACAGGCAAGCTGATCATCGATGA
AAACATCTACTACTTCGACGATAACTACCGCGGAGCTGTGGAGTGGAAAGAACTGGACGGCGAGATGCAC
TATTTCTCTCCAGAAACCGGCAAGGCCTTCAAGGGGCTGAATCAGATCGGAGACTACAAGTACTATTTCA
ACAGCGATGGCGTGATGCAGAAGGGGTTTGTCTCCATCAATGACAACAAACACTACTTCGACGATAGCGG
AGTGATGAAGGTCGGCTACACCGAGATTGATGGCAAACATTTCTATTTTGCTGAGAATGGGGAAATGCAA
ATCGGAGTGTTCAACACAGAAGATGGCTTCAAGTACTTTGCCCACCATAATGAGGACCTGGGCAACGAGG
AAGGGGAGGAAATTTCCTACTCTGGCATCCTGAACTTCAACAACAAAATCTACTATTTCGACGATAGCTT
CACCGCAGTGGTGGGATGGAAGGACCTGGAGGATGGAAGCAAATACTATTTTGACGAGGATACCGCCGAA
GCTTACATTGGCCTGTCCCTGATCAATGACGGGCAGTACTACTTCAACGACGATGGCATTATGCAAGTGG
GGTTCGTCACCATCAACGACAAGGTGTTCTACTTTAGTGATTCAGGAATCATTGAGTCTGGCGTCCAGAA
TATTGACGATAACTACTTCTATATCGACGATAATGGGATCGTGCAGATTGGAGTCTTCGACACCAGCGAT
GGGTACAAGTATTTTGCACCCGCCAACACCGTGAATGACAACATCTACGGCCAGGCCGTCGAGTATTCAG
GCCTGGTGCGGGTCGGGGAAGACGTGTACTATTTCGGCGAGACTTACACCATTGAAACAGGGTGGATCTA
TGACATGGAGCAAGAAAGTGATAAGTACTATTTCAATCCTGAGACTAAGAAAGCCTGCAAAGGCATCAAC
CTGATTGACGATATCAAGTACTACTTCGATGAGAAGGGAATCATGAGAACCGGCCTGATCAGCTTCGAAA
ACAATAACTACTACTTCAACGAGAACGGGGAAATGCAGTTCGGATACATCAACATCGAGGACAAGATGTT
CTACTTCGGGGAAGATGGAGTGATGCAGATCGGAGTCTTTAACACACCCGACGGCTTCAAATACTTTGCC
CACCAGAATACTCTGGATGAGAACTTCGAGGGGGAATCTATCCAGTACACCGGATGGCTGGACCTGGATG
```

FIG. 52 (continued)

SEQ ID NO:27 (continued)

```
AGAAGAGGTACTATTTCACCGACGAGTACATCGCCGCTACAGGCAGTGTGATTATCGACGGCGAGGAGTA
TTACTTCGATCCCGACACCGCTCAGCTGGTCATCTCAGAGTAATAAACTAGTAACGGCCGCCAGTGTGCT
GGAATTCGCCCTTATAACTTCGTATAGCATACATTATACGAAGTTATTGTTGACAATTAATCATCGGCAT
AGTATATCGGCATAGTATAATACGACAAGGTGAGGAACTAAACCATGGCCAAGTTGACCAGTGCCGTTCC
GGTGCTCACCGCGCGCGACGTCGCCGGAGCGGTCGAGTTCTGGACCGACCGGCTCGGGTTCTCCCGGGAC
TTCGTGGAGGACGACTTCGCCGGTGTGGTCCGGGACGACGTGACCCTGTTCATCAGCGCGGTCCAGGACC
AGGTGGTGCCGGACAACACCCTGGCCTGGGTGTGGGTGCGCGGCCTGGACGAGCTGTACGCCGAGTGGTC
GGAGGTCGTGTCCACGAACTTCCGGGACGCCTCCGGGCCGGCCATGACCGAGATCGGCGAGCAGCCGTGG
GGGCGGGAGTTCGCCCTGCGCGACCCGGCCGGCAACTGCGTGCACTTCGTGGCCGAGGAGCAGGACTGAA
TAACTTCGTATAGCATACATTATACGAAGTTATAAGGGCGAATTCTGCAGATATCCATCCTTTAAAAAAC
CTCCCACACCTCCCCCTGAACCTGAAACATAAAATGAATGCAATTGTTGTTGTTAACTTGTTTATTGCAG
CTTATAATGGTTACAAATAAAGCAATAGCATCACAAATTTCACAATAAAGCATTTTTTCACTGCATTC
TAGTTGTGGTTTGTCCAAACTCATCAATGTATCTTAACAACGTGTTTATTTTTCAATTGCAGAAAGAATT
GCAGAAATTTCAAGTCATTTTTCATTCAGTAGTATAGCCCCACCACCACATAGCTTATACTAATCACCG
TACCTTAATCAAACTCACAGAACCCTAGTATTCAACCTGCCACCTCCCTCCCAACACACAGAGTACACAG
TCCTTTCTCCCGGCTGGCCTTAAACAGCATCATATCATGGGTAACAGACATATTCTTAGGTGTTATATT
CCACACGGTCTCCTGTCGAGCCAAACGCTCATCAGTGATGTTAATAAACTCCCCGGGCAGCTCGCTTAAG
TTCATGTCGCTGTCCAGCTGCTGAGCCACAGGCTGCTGTCCAACTTGCGGTTGCTCAACGGGCGGCGAAG
GAGAAGTCCACGCCTACATGGGGGTAGAGTCATAATCGTGCATCAGGATAGGGCGGTGGTGCTGCAGCAG
CGCGCGAATAAACTGCTGCCGCCGCCGCTCCGTCCTGCAGGAATACAACATGGCAGTGGTCTCCTCAGCG
ATGATTCGCACCGCCCGCAGCATAAGGCGCCTTGTCCTCCGGGCACAGCAGCGCACCCTGATCTCACTTA
AGTCAGCACAGTAACTGCAGCACAGTACCACAATATTGTTTAAAATCCCACAGTGCAAGGCGCTGTATCC
AAAGCTCATGGCGGGGACCACAGAACCCACGTGGCCATCATACCACAAGCGCAGGTAGATTAAGTGGCGA
CCCCTCATAAACACGCTGGACATAAACATTACCTCTTTTGGCATGTTGTAATTCACCACCTCCCGGTACC
ATATAAACCTCTGATTAAACATGGCGCCATCCACCACCATCCTAAACCAGCTGGCCAAAACCTGCCCGCC
GGCTATGCACTGCAGGGAACCGGGACTGGAACAATGACAGTGGAGAGCCCAGGACTCGTAACCATGGATC
ATCATGCTCGTCATGATATCAATGTTGGCACAACACAGGCACACGTGCATACACTTCCTCAGGATTACAA
GCTCCTCCCGCGTCAGAACCATATCCCAGGGAACAACCCATTCCTGAATCAGCGTAAATCCCACACTGCA
GGGAAGACCTCGCACGTAACTCACGTTGTGCATTGTCAAAGTGTTACATTCGGGCAGCAGCGGATGATCC
TCCAGTATGGTAGCGCGTGTCTCTGTCTCAAAAGGAGGTAGGCGATCCCTACTGTACGGAGTGCGCCGAG
ACAACCGAGATCGTGTTGGTCGTAGTGTCATGCCAAATGGAACGCCGGACGTAGTCATATTTCCTGAAGC
AAAACCAGGTGCGGGCGTGACAAACAGATCTGCGTCTCCGGTCTCGTCGCTTAGCTCGCTCTGTGTAGTA
GTTGTAGTATATCCACTCTCTCAAAGCATCCAGGCGCCCCCTGGCTTCGGGTTCTATGTAAACTCCTTCA
TGCGCCGCTGCCCTGATAACATCCACCACCGCAGAATAAGCCACACCCAGCCAACCTACACATTCGTTCT
GCGAGTCACACACGGGAGGAGCGGGAAGAGCTGGAAGAACCATGTTTTTTTTTTTTATTCCAAAAGATTA
TCCAAAACCTCAAAATGAAGATCTATTAAGTGAACGCGCTCCCCTCCGGTGGCGTGGTCAAACTCTACAG
CCAAAGAACAGATAATGGCATTTGTAAGATGTTGCACAATGGCTTCCAAAAGGCAAACTGCCCTCACGTC
CAAGTGGACGTAAAGGCTAAACCCTTCANGGTGAATCTCCTCTATAAACATTCCAGCACCTTCAACCATG
CCCAAATAATTTTCATCTCGCCACCTTATCAATATGTCTCTAAGCAAATCCCGAATATTAAGTCCGGCCA
TTGTAAAAATCTGCTCCAGAGCGCCCTCCACCTTCAGCCTCAAGCAGCGAATCATGATTGCAAAAATTCA
GGTTCCTCACAGACCTGTATAAGATTCAAAAGCGGAACATTAACAAAAATACCGCGATCCCGTAGGTCCC
TTCGCAGGGCCAGCTGAACATAATCGTGCAGGTCTGCACGGACCAGCGCGGCCACTTCCCCGCCAGGAAC
CATGACAAAAGAACCCACACTGATTATGACACGCATACTCGGAGCTATGCTAACCAGCGTAGCCCCGATG
TAAGCTTGTTGCATGGGCGGCGATATAAAATGCAAGGTACTGCTCAAAAAATCAGGCAAAGCCTCGCGCA
AAAAAGCAAGCACATCGTAGTCATGCTCATGCAGATAAAGGCAGGTAAGTTCCGGAACCACCACAGAAAA
AGACACCATTTTTCTCTCAAACATGTCTGCGGGTTCCTGCATAAACACAAAATAAATAACAAAAAAAA
AAAACATTTAAACATTAGAAGCCTGTCTTACAACAGGAAAAACAACCCTTATAAGCATAAGACGGACTAC
GGCCATGCCGGCGTGACCGTAAAAAACTGGTCACCGTGATTAAAAAGCACCACCGACAGTTCCTCGGTC
ATGTCCGGAGTCATAATGTAAGACTCGGTAAACACATCAGGTTGGTTAACATCGGTCAGTGCTAAAAAGC
GACCGAAATAGCCCGGGGAATACATACCCGCAGGCGTAGAGACAACATTACAGCCCCCATAGGAGGTAT
AACAAAATTAATAGGAGAGAAAAACACATAAACCCCTGAAAAACCCTCCTGCCCCTAGGCAAAATAGCAC
CCTCCCGCTCCAGAACAACATACAGCGCTTCCACAGCGGCAGCCATAACAGTCAGCCTTACCAGTAAAAA
```

SEQ ID NO:27 (continued)

AACCTATTAAAAAACACCACTCGACACGGCACCAGCTCAATCAGTCACAGTGTAAAAGGGCCAAGTACA
GAGCGAGTATATATAGGACTAAAAAATGACGTAACGGTTAAAGTCCACAAAAACCACCCAGAAAACCGCA
CGCGAACCTACGCCCAGAAACGAAAGCCAAAAAACCCACAACTTCCTCAAATCTTCACTTCCGTTTTCCC
ACGATACGTCACTTCCCATTTTAAAAAAAACTACAATTCCCAATACATGCAAGTTACTCCGCCCTAAAA
CCTACGTCACCCGCCCCGTTCCCACGCCCCGCGCCACGTCACAAACTCCACCCCCTCATTATCATATTGG
CTTCAATCCAAAATAAGGTATATTATTGATGATGGCGAT

FIG. 52 (continued)

SEQ ID NO:28

CGCCATCATCAATAATATACCTTATTTTGGATTGAAGCCAATATGATAATGAGGGGGTGGAGTTTGTGAC
GTGGCGCGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTTACGTGGAGACTCGCCCAGGTGTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGGTAAAGAGGGAGCGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGGTGGTTATTATGA
ATGTGAGGTTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGTGGTGTGTCGCCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC
GCACCAGGTGCAGACCCTGCGAGTGTGGCGGTAAACATATTAGGAACCAGCCTGTGATGCTGGATGTGAC

FIG. 53

SEQ ID NO:28 (continued)

```
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGGATATGAG
ATGCATCTTGGACTGTATTTTAGGTTGGCTATGTTCCCAGCCATATCCCTCCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGATCATGTCTACCTG
CGGGGCGATGAAGAAAACCGTTTCCGGGGTAGGGAGATCAGCTGGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGCCACTTCGTTAAGCATGTCCCTGACTTGCATGTTTTCCT
GACCAAATCCGCCAGAAGGCGCTCGCCGCCCAGCGATAGCAGTTCTTGCAAGGAAGCAAAGTTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGGCGCCGCACGAGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCTGGTCAGAAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGACCCCATGGCATGGGTGGGTGAGCGCGGAGGCG
TACATGCCGCAAATGTCGTAAACGTAGAGGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
CGCGCAGCTTGTTGACCAGCTCGGCGGTGACCTGCACGTCTAGGGCGCAGTAGTCCAGGGTTTCCTTGAT
```

FIG. 53 (continued)

SEQ ID NO:28 (continued)

```
GATGTCATACTTATCCTGTCCCTTTTTTTTCCACAGCTCGCGGTTGAGGACAAACTCTTCGCGGTCTTTC
CAGTACTCTTGGATCGGAAACCCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAAGTCCGTGCGCTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCGCGGCGCGACTACGGTACCGCGCGG
CGGGCGGTGGGCCGCGGGGGTGTCCTTGGATGATGCATCTAAAAGCGGTGACGCGGGCGGGCCCCCGGAG
GTAGGGGGGCTCGGGACCCGCCGGGAGAGGGGGCAGGGCACGTCGGCGCCGCGCGGGCAGGAGCTG
GTGCTGCGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCCAAGGCCTCAAGGCGCTCCATGGCCTCGTAGAAGTCCACGG
CGAAGTTGAAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGGCCTCTTCTTCTTCTTCAATCTCCTCTTCCATA
AGGGCCTCCCCTTCTTCTTCTTCTGGCGGCGGTGGGGAGGGGGACACGGCGGCGACGACGGCGCACCG
GGAGGCGGTCGACAAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAGTGCGGCGGCGG
CTGGCGGTAGAGGGGCCAGCGTAGGGTGGCCGGGGCTCCGGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
TAAATTCGCAAGGGTATCATGGCGGACGACCGGGGTTCGAACCCCGGATCCGGCCGTCCGCCGTGATCCA
```

SEQ ID NO:28 (continued)

```
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGTTTGACCCCGTCACTGGTCTTGTCATGCCTGGGGTATATA
CAAACGAAGCCTTCCATCCAGACATCATTTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCCGGTGGTGGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTTGGCGCGCCCGCCAGCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
ACACCCAGTGCGCGTGCGCGGGCACTACCGCGCGCCCTGGGGCGCGCACAAACGCGGCCGCACTGGGCGC
```

FIG. 53 (continued)

SEQ ID NO:28 (continued)

```
ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAGAAGAGATGCTCCAGGTCATCGCGCCGGAGATCTA
TGGCCCCCGAAGAAGGAAGAGCAGGATTACAAGCCCCGAAAGCTAAAGCGGGTCAAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCGAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCCGGCGTCCGCGCCGTTCAAGGAAGTACGGCGCCGCCAGCGCGCTACTGCCCGAATATGCCCT
ACATCCTTCCATCGCGCCTACCCCCGGCTATCGTGGCTACACCTACCGCCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAAATAAAAGTCTGGACTCTCACGCTCGCTTGGTCCTGTAACTATTTT
GTAGAATGGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CCGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTTTGGGGGTGCAATCCCTGAAGCGCCGACGATGCTTCTGATAGCTAACGTGT
CGTATGTGTGTCATGTATGCGTCCATGTCGCCGCCAGAGGAGCTGCTGAGCCGCCGCGCGCCCGCTTTCC
AAGATGGCTACCCCTTCGATGATGCCGCAGTGGTCTTACATGCACATCTCGGGCCAGGACGCCTCGGAGT
ACCTGAGCCCCGGGCTGGTGCAGTTCGCCCGCGCCACCGAGACGTACTTCAGCCTGAATAACAAGTTTAG
AAACCCCACGGTGGCGCCTACGCACGACGTGACCACAGACCGGTCTCAGCGTTTGACGCTGCGGTTCATC
CCCGTGGACCGCGAGGATACTGCGTACTCGTACAAGGCGCGGTTCACCCTAGCTGTGGGTGATAACCGTG
TGCTAGACATGGCTTCCACGTACTTTGACATCCGCGGCGTGCTGGACAGGGGCCCTACTTTTAAGCCCTA
CTCTGGCACTGCCTACAACGCACTGGCCCCAAGGGTGCCCCAACTCGTGCGAGTGGGAACAAAATGAA
ACTGCACAAGTGGATGCTCAAGAACTTGACGAAGAGGAGAATGAAGCCAATGAAGCTCAGGCGCGAGAAC
AGGAACAAGCTAAGAAAACCCATGTATATGCCCAGGCTCCACTGTCCGGAATAAAAATAACTAAAGAAGG
TCTACAAATAGGAACTGCCGACGCCACAGTAGCAGGTGCCGGCAAAGAAATTTTCGCAGACAAAACTTTT
CAACCTGAACCACAAGTAGGAGAATCTCAATGGAACGAAGCGGATGCCACAGCAGCTGGTGGAAGGGTTC
TTAAAAAGACAACTCCCATGAAACCCTGCTATGGCTCATACGCTAGACCCACCAATTCCAACGGCGGACA
GGGCGTTATGGTTGAACAAAATGGTAAATTGGAAAGTCAAGTCGAAATGCAATTTTTTTCCACATCCACA
```

SEQ ID NO:28 (continued)

```
AATGCCACAAATGAAGTTAACAATATACAACCAACAGTTGTATTGTACAGCGAAGATGTAAACATGGAAA
CTCCAGATACTCATCTTTCTTATAAACCTAAAATGGGGGATAAAAATGCCAAAGTCATGCTTGGACAACA
AGCAATGCCAAACAGACCAAATTACATTGCTTTTAGAGACAATTTTATTGGTCTCATGTATTACAACAGC
ACAGGTAACATGGGTGTCCTTGCTGGTCAGGCATCGCAGTTGAACGCTGTTGTAGATTTGCAAGACAGAA
ACACAGAGCTGTCCTACCAGCTTTTGCTTGATTCAATTGGCGACAGAACAAGATACTTTTCAATGTGGAA
TCAAGCTGTTGACAGCTATGATCCAGATGTCAGAATTATTGAGAACCATGGAACTGAGGATGAGTTGCCA
AATTATTGCTTTCCTCTTGGTGGAATTGGGATTACTGACACTTTTCAAGCTGTTAAAACAACTGCTGCTA
ACGGGGACCAAGGCAATACTACCTGGCAAAAGATTCAACATTTGCAGAACGCAATGAAATAGGGGTGGG
AAATAACTTTGCCATGGAAATTAACCTGAATGCCAACCTATGGAGAAATTTCCTTTACTCCAATATTGCG
CTGTACCTGCCAGACAAGCTAAAATACAACCCCACCAATGTGGAAATATCTGACAACCCCAACACCTACG
ACTACATGAACAAGCGAGTGGTGGCTCCTGGGCTTGTAGACTGCTACATTAACCTTGGGGCGCGCTGGTC
TCTGGACTACATGGACAACGTTAATCCCTTTAACCACCCCGCCATGCGGGCCTGCGTTACCGCTCCATG
TTGTTGGGAAACGGCCGCTACGTGCCCTTTCACATTCAGGTGCCCCAAAAGTTTTTGCCATTAAAAACC
TCCTCCTCCTGCCAGGCTCATACACATATGAATGGAACTTCAGGAAGGATGTTAACATGGTTCTGCAGAG
CTCTCTGGGAAACGACCTTAGAGTTGACGGGGCTAGCATTAAGTTTGACAGCATTTGTCTTTACGCCACC
TTCTTCCCCATGGCCCACAACACGGCCTCCACGCTGGAAGCCATGCTCAGAAATGACACCAACGACCAGT
CCTTTAATGACTACCTTTCCGCCGCCAACATGCTATATCCCATACCCGCCAACGCCACCAACGTGCCCAT
CTCCATCCCATCGCGCAACTGGGCAGCATTTCGCGGTTGGGCCTTCACACGCTTGAAGACAAAGGAAACC
CCTTCCCTGGGATCAGGCTACGACCCTTACTACACCTACTCTGGCTCCATACCATACCTTGACGGAACCT
TCTATCTTAATCACACCTTTAAGAAGGTGGCCATTACTTTTGACTCTTCTGTTAGCTGGCCGGGCAACGA
CCGCCTGCTTACTCCCAATGAGTTTGAGATTAAGCGCTCAGTTGACGGGGAGGGCTATAACGTAGCTCAG
TGCAACATGACAAAGGACTGGTTCCTAGTGCAGATGTTGGCCAACTACAATATTGGCTACCAGGGCTTCT
ACATTCCAGAAAGCTACAAAGACCGCATGTACTCGTTCTTCAGAAACTTCCAGCCCATGAGCCGGCAAGT
GGTGGACGATACTAAATACAAAGATTATCAGCAGGTTGGAATTATCCACCAGCATAACAACTCAGGCTTC
GTAGGCTACCTCGCTCCCACCATGCGCGAGGGACAAGCTTACCCGCTAATGTTCCCTACCCACTAATAG
GCAAAACCGCGGTTGATAGTATTACCCAGAAAAAGTTTCTTTGCGACCGCACCCTGTGGCGCATCCCCTT
CTCCAGTAACTTTATGTCCATGGGTGCGCTCACAGACCTGGGCCAAAACCTTCTCTACGCAAACTCCGCC
CACGCGCTAGACATGACCTTTGAGGTGGATCCCATGGACGAGCCCACCCTTCTTTATGTTTTGTTTGAAG
TCTTTGACGTGGTCCGTGTGCACCAGCCGCACCGCGGCGTCATCGAGACCGTGTACCTGCGCACGCCCTT
CTCGGCCGGCAACGCCACAACATAAAGAAGCAAGCAACATCAACAACAGCTGCCGCCATGGGCTCCAGTG
AGCAGGAACTGAAAGCCATTGTCAAAGATCTTGGTTGTGGGCCATATTTTTGGGCACCTATGACAAGCG
CTTCCCAGGCTTTGTTTCCCCACACAAGCTCGCCTGCGCCATAGTTAACACGGCCGGTCGCGAGACTGGG
GGCGTACACTGGATGGCCTTTGCCTGGAACCCGCGCTCAAAAACATGCTACCTCTTTGAGCCCTTTGGCT
TTTCTGACCAACGTCTCAAGCAGGTTTACCAGTTTGAGTACGAGTCACTCCTGCGCCGTAGCGCCATTGC
CTCTTCCCCCGACCGCTGTATAACGCTGGAAAAGTCCACCCAAAGCGTGCAGGGGCCCAACTCGGCCGCC
TGTGGCCTATTCTGCTGCATGTTTCTCCACGCCTTTGCCAACTGGCCCCAAACTCCCATGGATCACAACC
CCACCATGAACCTTATTACCGGGGTACCCAACTCCATGCTTAACAGTCCCCAGGTACAGCCCACCCTGCG
CCGCAACCAGGAACAGCTCTACAGCTTCCTGGAGCGCCACTCGCCCTACTTCCGCAGCCACAGTGCGCAA
ATTAGGAGCGCCACTTCTTTTTGTCACTTGAAAAACATGTAAAAATAATGTACTAGGAGACACTTTCAAT
AAAGGCAAATGTTTTATTTGTACACTCTCGGGTGATTATTTACCCCCACCCTTGCCGTCTGCGCCGTTT
AAAAATCAAAGGGGTTCTGCCGCGCATCGCTATGCGCCACTGGCAGGGACACGTTGCGATACTGGTGTTT
AGTGCTCCACTTAAACTCAGGCACAACCATCCGCGGCAGCTCGGTGAAGTTTTCACTCCACAGGCTGCGC
ACCATCACCAACGCGTTTAGCAGGTCGGGCGCCGATATCTTGAAGTCGCAGTTGGGCCTCCGCCCTGCG
CGCGCGAGTTGCGATACACAGGGTTACAGCACTGGAACACTATCAGCGCCGGTGGTGCACGCTGGCCAG
CACGCTCTTGTCGGAGATCANATCCGCGTCCAGGTCCTCCGCGTTGCTCAGGGCAACGGAGTCAACTTT
GGTAGCTGCCTTCCCAAAAAGGGTGCATGCCCAGGCTTTGAGTTGCACTCGCACCGTAGTGGCATCAGAA
GGTGACCGTGCCCAGTCTGGGCGTTAGGATACAGCGCCTGCATGAAGCCTTGATCTGCTTAAAAGCCAC
CTGAGCCTTTGCGCCTTCAGAGAAGAACATGCCGCAAGACTTGCCGGAAAACTGATTGGCCGGACAGGCC
GCGTCATGCACGCAGCACCTTGCGTCGGTGTTGGAGATCTGCACCACATTTCGGCCCCACCGGTTCTTCA
CGATCTTGGCCTTGCTAGACTGCTCCTTCAGCGCGCGCTGCCCGTTTTCGCTCGTCACATCCATTTCAAT
CACGTGCTCCTTATTTATCATAATGCTCCCGTGTAGACACTTAAGCTCGCCTTCGATCTCAGCGCAGCGG
TGCAGCCACAACGCGCAGCCCGTGGGCTCGTGGTGCTTGTAGGTTACCTCTGCAAACGACTGCAGGTACG
```

FIG. 53 (continued)

SEQ ID NO:28 (continued)

```
CCTGCAGGAATCGCCCCATCATCGTCACAAAGGTCTTGTTGCTGGTGAAGGTCAGCTGCAACCCGCGGTG
CTCCTCGTTTAGCCAGGTCTTGCATACGGCCGCCAGAGCTTCCACTTGGTCAGGCAGTAGCTTGAAGTTT
GCCTTTAGATCGTTATCCACGTGGTACTTGTCCATCAACGCGCGCGCAGCCTCCATGCCCTTCTCCCACG
CAGACACGATCGGCAGGCTCAGCGGGTTTATCACCGTGCTTTCACTTTCCGCTTCACTGGACTCTTCCTT
TTCCTCTTGCATCCGCATACCCCGCGCCACTGGGTCGTCTTCATTCAGCCGCCGCACCGTGCGCTTACCT
CCCTTGCCGTGCTTGATTAGCACCGGTGGGTTGCTGAAACCCACCATTTGTAGCGCCACATCTTCTCTTT
CTTCCTCGCTGTCCACGATCACCTCTGGGGATGGCGGGCGCTCGGGCTTGGGAGAGGGGCGCTTCTTTTT
CTTTTTGGACGCAATGGCCAAATCCGCCGTCGAGGTCGATGGCCGCGGGCTGGGTGTGCGCGGCACCAGC
GCATCTTGTGACGAGTCTTCTTCGTCCTCGGACTCGAGACGCCGCCTCAGCCGCTTTTTTGGGGCGCGC
GGGGAGGCGGCGGCGACGGCGACGGGGACGAGACGTCCTCCATGGTTGGTGGACGTCGCGCCGCACCGCG
TCCGCGCTCGGGGGTGGTTTCGCGCTGCTCCTCTTCCCGACTGGCCATTTCCTTCTCCTATAGGCAGAAA
AAGATCATGGAGTCAGTCGAGAAGGAGGACAGCCTAACCGCCCCCTTTGAGTTCGCCACCACCGCCTCCA
CCGATGCCGCCAACGCGCCTACCACCTTCCCCGTCGAGGCACCCCGCTTGAGGAGGAGGAAGTGATTAT
CGAGCAGGACCCAGGTTTTGTAAGCGAAGACGACGAAGATCGCTCAGTACCAACAGAGGATAAAAAGCAA
GACCAGGACGACGCAGAGGCAAACGAGGAACAAGTCGGGCGGGGGGACCAAAGGCATGGCGACTACCTAG
ATGTGGGAGACGACGTGCTGTTGAAGCATCTGCAGCGCCAGTGCGCCATTATCTGCGACGCGTTGCAAGA
GCGCAGCGATGTGCCCCTCGCCATAGCGGATGTCAGCCTTGCCTACGAACGCCACCTGTTCTCACCGCGC
GTACCCCCAAACGCCAAGAAAACGGCACATGCGAGCCCAACCCGCGCCTCAACTTCTACCCCGTATTTG
CCGTGCCAGAGGTGCTTGCCACCTATCACATCTTTTTCCAAAACTGCAAGATACCCCTATCCTGCCGTGC
CAACCGCAGCCGAGCGGACAAGCAGCTGGCCTTGCGGCAGGGCGCTGTCATACCTGATATCGCCTCGCTC
GACGAAGTGCCAAAAATCTTTGAGGGTCTTGGACGCGACGAGAAGCGCGCGGCAAACGCTCTGCAACAAG
AAAACAGCGAAAATGAAAGTCACTGTGGAGTGCTGGTGGAACTTGAGGGTGACAACGCGCGCCTAGCCGT
GCTGAAACGCAGCATCGAGGTCACCCACTTTGCCTACCCGGCACTTAACCTACCCCCAAGGTTATGAGC
ACAGTCATGAGCGAGCTGATCGTGCGCCGTGCACGACCCCTGGAGAGGGATGCAAACTTGCAAGAACAAA
CCGAGGAGGGCCTACCCGCAGTTGGCGATGAGCAGCTGGCGCGCTGGCTTGAGACGCGCGAGCCTGCCGA
CTTGGAGGAGCGACGCAAGCTAATGATGGCCGCAGTGCTTGTTACCGTGGAGCTTGAGTGCATGCAGCGG
TTCTTTGCTGACCCGGAGATGCAGCGCAAGCTAGAGGAAACGTTGCACTACACCTTTCGCCAGGGCTACG
TGCGCCAGGCCTGCAAAATTTCCAACGTGGAGCTCTGCAACCTGGTCTCCTACCTTGGAATTTTGCACGA
AAACCGCCTTGGGCAAAACGTGCTTCATTCCACGCTCAAGGGCGAGGCGCGCCGCGACTACGTCCGCGAC
TGCGTTTACTTATTTCTGTGCTACACCTGGCAAACGGCCATGGGCGTGTGGCAGCAGTGCCTGGAGGAGC
GCAACCTGAAGGAGCTGCAGAAGCTGCTAAAGCAAAACTTGAAGGACCTATGGACGGCCTTCAACGAGCG
CTCCGTGGCCGCGCACCTGGCGGACATTATCTTCCCCGAACGCCTGCTTAAAACCCTGCAACAGGGTCTG
CCAGACTTCACCAGTCAAAGCATGTTGCAAAACTTTAGGAACTTTATCCTAGAGCGTTCAGGAATTCTGC
CCGCCACCTGCTGTGCGCTTCCTAGCGACTTTGTGCCCATTAAGTACCGTGAATGCCCTCCGCCGCTTTG
GGGTCACTGCTACCTTNTGCAGCTAGCCAACTACCTTGCCTACCACTCCGACATCATGGAAGACGTGAGC
GGTGACGGCCTACTGGAGTGTCACTGTCGCTGCAACCTATGCACCCCGCACCGCTCCCTGGTCTGCAATT
CACAACTGCTTAGCGAAAGTCAAATTATCGGTACCTTTGAGCTGCAGGGTCCCTCGCCTGACGAAAAGTC
CGCGGCTCCGGGGTTGAAACTCACTCCGGGGCTGTGGACGTCGGCTTACCTTCGCAAATTTGTACCTGAG
GACTACCACGCCCACGAGATTAGGTTCTACGAAGACCAATCCCGCCCGCCAAATGCGGAGCTTACCGCCT
GCGTCATTACCCAGGGCCACATCCTTGGCCAATTGCAAGCCATTAACAAAGCCCGCCAAGAGTTTCTGCT
ACGAAAGGGACGGGGGGTTTACTTGGACCCCAGTCCGGCGAGGAGCTCAACCCAATCCCCCCGCCGCCG
CAGCCCTATCAGCAGCCGCGGGCCCTTGCTTCCCAGGATGGCACCCAAAAAGAAGCTGCAGCTGCCGCCG
CCGCCACCCACGGACGAGGAGGAATACTGGGACAGTCAGGCAGAGGAGGTTTTGGACGAGGAGGAGGAGA
TGATGGAAGACTGGGACAGCCTAGACGAGGAAGCTTCCGAGGCCGAAGAGGTGTCAGACGAAACACCGTC
ACCCTCGGTCGCATTCCCCTCGCCGGCGCCCCAGAAATCGGCAACCGTTCCCAGCATTGCTACAACCTCC
GCTCCTCAGGCGCCGCCGGCACTGCCCGTTCGCCGACCCAACCGTAGATGGGACACCACTGGAACCAGGG
CCGGTAAGTCTAAGCAGCCGCCGCCGTTAGCCCAAGAGCAACAACAGCGCCAAGGCTACCGCTCGTGGCG
CGTGCACAAGAACGCCATAGTTGCTTGCTTGCAAGACTGTGGGGGCAACATCTCCTTCGCCCGCCGCTTT
CTTCTCTACCATCACGGCGTGGCCTTCCCCCGTAACATCCTGCATTACTACCGTCATCTCTACAGCCCCT
ACTGCACCGGCGGCAGCGGCAGCAACAGCAGCGGCCACGCAGAAGCAAAGGCGACCGGATAGCAAGACTC
TGACAAAGCCCAAGAAATCCACAGCGGCGGCAGCAGCAGGAGGAGGAGCACTGCGTCTGGCGCCCAACGA
ACCCGTATCGACCCGCGAGCTTAGAAACAGGATTTTTCCCACTCTGTATGCTATATTTCAACAGAGCAGG
```

FIG. 53 (continued)

SEQ ID NO:28 (continued)

```
GGCCAAGAACAAGAGCTGAAAATAAAAAACAGGTCTCTGCGCTCCCTCACCCGCAGCTGCCTGTATCACA
AAAGCGAAGATCAGCTTCGGCGCACGCTGGAAGACGCGGAGGCTCTCTTCAGCAAATACTGCGCGCTGAC
TCTTAAGGACTAGTTTCGCGCCCTTTCTCAAATTTAAGCGCGAAAACTACGTCATCTCCAGCGGCCACAC
CCGGCGCCAGCACCTGTCGTCAGCGCCATTATGAGCAAGGAAATTCCCACGCCCTACATGTGGAGTTACC
AGCCACAAATGGGACTTGCGGCTGGAGCTGCCCAAGACTACTCAACCCGAATAAACTACATGAGCGCGGG
ACCCCACATGATATCCCGGGTCAACGGAATCCGCGCCCACCGAAACCGAATTCTCCTCGAACAGGCGGCT
ATTACCACCACACCTCGTAATAACCTTAATCCCCGTAGTTGGCCCGCTGCCCTGGTGTACCAGGAAAGTC
CCGCTCCCACCACTGTGGTACTTCCCAGAGACGCCCAGGCCGAAGTTCAGATGACTAACTCAGGGGCGCA
GCTTGCGGGCGGCTTTCGTCACAGGGTGCGGTCGCCCGGGCAGGGTATAACTCACCTGAAAATCAGAGGG
CGAGGTATTCAGCTCAACGACGAGTCGGTGAGCTCCTCTCTTGGTCTCCGTCCGGACGGGACATTTCAGA
TCGGCGGCGCTGGCCGCTCTTCATTTACGCCCCGTCAGGCGATCCTAACTCTGCAGACCTCGTCCTCGGA
GCCGCGCTCCGGAGGCATTGGAACTCTACAATTTATTGAGGAGTTCGTGCCTTCGGTTTACTTCAACCCC
TTTTCTGGACCTCCCGGCCACTACCCGGACCAGTTTATTCCCAACTTTGACGCGGTAAAAGACTCGGCGG
ACGGCTACGACTGACAGATCTGAGCTCGCGGCCGCGATATCGCTAGCGAAGTTCCTATTCTCTAGAAAGT
ATAGGAACTTCGATCCTCTAGAGTCGACCTGCAGGCATGCAAGCTTGGCACTGCAATAAATTACTTACTT
AAAATCAGTCAGCAAATCTTTGTCCAGCTTATTCAGCATCACCTCCTTTCCCTCCTCCCAACTCTGGTAT
TTCAGCAGCCTTTTAGCTGCGAACTTTCTCCAAAGTCTAAATGGGATGTCAAATTCCTCATGTTCTTGTC
CCTCCGCACCCACTATCTTCATATTGTTGCAGATGAAACGCGCCAGACCGTCTGAAGACACCTTCAACCC
TGTGTACCCATATGACACGGAAACCGGCCCTCCAACTGTGCCTTTCCTTACCCCTCCCTTTGTGTCGCCA
AATGGGTTCCAAGAAAGTCCCCCCGGAGTGCTTTCTTTGCGTCTTTCAGAACCTTTGGTTACCTCACACG
GCATGCTTGCGCTAAAAATGGGCAGCGGCCTGTCCCTGGATCAGGCAGGCAACCTTACATCAAATACAAT
CACTGTTTCTCAACCGCTAAAAAAACAAAGTCCAATATAACTTTGGAAACATCCGCGCCCCTTACAGTC
AGCTCAGGCGCCCTAACCATGGCCACAACTTCGCCTTTGGTGGTCTCTGACAACACTCTTACCATGCAAT
CACAAGCACCGCTAACCGTGCAAGACTCAAAACTTAGCATTGCTACCAAAGAGCCACTTACAGTGTTAGA
TGGAAAACTGGCCCTGCAGACATCAGCCCCCCTCTCTGCCACTGATAACAACGCCCTCACTATCACTGCC
TCACCTCCTCTTACTACTGCAAATGGTAGTCTGGCTGTTACCATGGAAAACCCACTTTACAACAACAATG
GAAAACTTGGGCTCAAAATTGGCGGTCCTTTGCAAGTGGCCACCGACTCACATGCACTAACACTAGGTAC
TGGTCAGGGGGTTGCAGTTCATAACAATTTGCTACATACAAAAGTTACAGGCGCAATAGGGTTTGATACA
TCTGGCAACATGGAACTTAAAACTGGAGATGGCCTCTATGTGGATAGCGCCGGTCCTAACCAAAAACTAC
ATATTAATCTAAATACCACAAAAGGCCTTGCTTTTGACAACACCGCAATAACAATTAACGCTGGAAAAGG
GTTGGAATTTGAAACAGACTCCTCAAACGGAAATCCCATAAAAACAAAAATTGGATCAGGCATACAATAT
AATACCAATGGAGCTATGGTTGCAAAACTTGGAACAGGCCTCAGTTTTGACAGCTCCGGAGCCATAACAA
TGGGCAGCATAAACAATGACAGACTTACTCTTTGGACAACACCAGACCCATCCCCAAATTGCAGAATTGC
TTCAGATAAAGACTGCAAGCTAACTCTGGCGCTAACAAAATGTGGCAGTCAAATTTTGGGCACTGTTTCA
GCTTTGGCAGTATCAGGTAATATGGCCTCCATCAATGGAACTCTAAGCAGTGTAAACTTGGTTCTTAGAT
TTGATGACAACGGAGTGCTTATGTCAAATTCATCACTGGACAAACAGTATTGGAACTTTAGAAACGGGGA
CTCCACTAACGGTCAACCATACACTTATGCTGTTGGGTTTATGCCAAACCTAAAAGCTTACCCAAAAACT
CAAAGTAAAACTGCAAAAGTAATATTGTTAGCCAGGTGTATCTTAATGGTGACAAGTCTAAACCATTGC
ATTTTACTATTACGCTAAATGGAACAGATGAAACCAACCAAGTAAGCAAATACTCAATATCATTCAGTTG
GTCCTGGAACAGTGGACAATACACTAATGACAAATTTGCCACCAATTCCTATACCTTCTCCTACATTGCC
CAGGAATAAAGAATCGTGAACCTGTTGCATGTTATGTTTCAACGTGTTTATTTTTCAATTCGTATTAGTC
ATCGCTATTACCATGGTGATGCGGTTTTGGCAGTACATCAATGGGCGTGGATAGCGGTTTGACTCACGGG
GATTTCCAAGTCTCCACCCCATTGACGTCAATGGGAGTTTGTTTTGGCACCAAAATCAACGGGACTTTCC
AAAATGTCGTAACAACTCCGCCCCATTGACGCAAATGGGCGGTAGGCGTGTACGGTGGGAGGTCTATATA
AGCAGAGCTGGTTTAGTGAACCGTCAGATCCGCTAGAGATCCACCATGTTTGTCTTTCTCGTGCTGCTGC
CCCTCGTGAGCAGCCAGTGCGTCAATCTGACAACAAGGACCCAGCTGCCCCCGCCTACACCAACTCCTT
CACAAGAGGCGTGTATTACCCCGATAAGGTCTTCAGATCCAGCGTCCTCCACAGCACCCAAGATTTGTTT
CTGCCTTTCTTCAGCAACGTGACATGGTTCCACGCCATTCATGTCAGCGGCACAAACGGCACAAAGAGGT
TTGACAACCCCGTGCTCCCCTTCAACGACGGCGTGTACTTCGCCAGCACAGAGAAATCCAATATCATTAG
GGGCTGGATCTTCGGCACAACACTGGATTCCAAGACCCAGTCTCTGCTCATTGTGAATAACGCCACCAAC
GTGGTGATTAAGGTCTGTGAGTTTCAGTTCTGCAACGACCCCTTTCTGGGAGTCTACTACCACAAGAATA
ATAAGAGCTGGATGGAGTCCGAGTTTAGGGTGTACAGCTCCGCCAACAACTGTACCTTCGAATACGTGTC
```

SEQ ID NO:28 (continued)

```
CCAGCCTTTCCTCATGGATCTGGAGGGCAAGCAAGGCAATTTCAAAAATCTGAGAGAGTTCGTGTTCAAA
AACATTGATGGATACTTCAAAATCTACAGCAAGCATACCCCCATTAATCTGGTGAGGGATCTGCCCCAAG
GATTCTCCGCTCTGGAACCTCTGGTGGATCTGCCCATTGGCATTAACATCACAAGATTCCAGACCCTCCT
CGCCCTCCATAGATCCTATCTGACCCCGGCGACTCCTCCAGCGGATGGACAGCCGGAGCTGCCGCCTAC
TACGTGGGCTATCTGCAGCCAAGAACCTTTCTGCTGAAGTACAACGAGAACGGCACCATCACAGACGCTG
TCGATTGCGCTCTCGACCCTCTGAGCGAGACCAAATGCACACTGAAGAGCTTCACCGTGGAAAGGGCAT
CTATCAGACCAGCAACTTCAGAGTGCAGCCTACCGAGAGCATTGTGAGGTTTCCCAACATCACCAATCTG
TGTCCTTTCGGCGAGGTCTTTAATGCCACAAGGTTCGCTTCCGTGTATGCTTGGAATAGGAAGAGGATCA
GCAATTGCGTCGCCGACTATTCCGTCCTCTATAACAGCGCCTCCTTCTCCACCTTCAAATGTTATGGCGT
GTCCCCCACCAAGCTCAACGACCTCTGCTTCACCAATGTGTACGCTGACTCCTTCGTCATTAGGGGCGAC
GAGGTGAGGCAAATTGCCCCGGCCAGACCGGCAAGATTGCTGATTACAACTACAAACTGCCCGACGATT
TTACCGGCTGCGTGATCGCTTGGAACTCCAACAATCTGGACTCCAAAGTGGGCGGAAACTACAATTACCT
CTACAGACTCTTTAGAAAAAGCAATCTGAAGCCCTTCGAGAGAGACATCTCCACCGAAATCTACCAAGCC
GGAAGCACACCTTGCAATGGCGTCGAGGGATTTAACTGCTACTTCCCTCTGCAGAGCTACGGCTTTCAAC
CTACCAACGGCGTCGGATATCAACCCTATAGGGTGGTCGTGCTGAGCTTTGAACTGCTGCATGCTCCCGC
CACCGTCTGCGGACCTAAGAAGAGCACCAATCTCGTCAAAAACAAGTGCGTGAACTTCAACTTCAATGGA
CTGACCGGCACCGGCGTGCTGACCGAGAGCAATAAGAAGTTTCTGCCCTTCCAGCAGTTCGGAAGGGATA
TTGCCGATACCACAGATGCTGTGAGGGACCCCCAAACCCTCGAGATTCTGGATATCACCCCTTGCAGCTT
CGGAGGAGTGTCCGTGATCACCCCGGAACAAACACCTCCAATCAAGTGGCTGTGCTGTACCAAGACGTG
AACTGCACAGAAGTCCCCGTGGCCATCCATGCCGACCAGCTGACCCCTACATGGAGAGTGTACTCCACCG
GCAGCAATGTGTTCCAGACAAGAGCCGGATGCCTCATTGGAGCTGAACACGTCAACAACAGCTACGAGTG
CGACATTCCCATCGGCGCCGGCATTTGTGCCTCCTATCAGACCCAGACCAACAGCCCAAGAAGGGCTAGA
AGCGTCGCTTCCCAATCCATCATTGCCTACACCATGTCTCTGGGAGCCGAAAACTCCGTCGCCTACTCCA
ACAATAGCATCGCCATCCCCACCAATTTTACCATCTCCGTGACCACAGAGATTCTGCCCGTGTCCATGAC
AAAGACATCCGTGGACTGCACCATGTACATCTGTGGCGACAGCACCGAGTGTAGCAATCTGCTGCTGCAA
TATGGCAGCTTCTGCACCCAGCTGAACAGAGCCCTCACCGGCATCGCCGTCGAACAAGACAAGAACACCC
AAGAGGTGTTCGCCCAAGTGAAGCAAATCTACAAGACCCCCCCTATCAAAGATTTCGGAGGATTCAACTT
TAGCCAGATTCTGCCCGATCCTAGCAAGCCTTCCAAGAGGAGCTTCATCGAGGATCTGCTGTTTAATAAG
GTGACACTGGCCGACGCTGGCTTCATTAAACAGTACGGCGATTGTCTGGGCGACATCGCTGCTAGGGATC
TGATCTGCGCTCAGAAGTTCAACGGACTGACAGTCCTCCCTCCTCTGCTGACCGACGAGATGATCGCTCA
GTATACCAGCGCTCTGCTGGCTGGAACCATTACCAGCGGCTGGACATTCGGCGCTGGAGCCGCCCTCCAA
ATTCCCTTTGCCATGCAGATGGCCTATAGATTCAACGGCATTGGCGTCACCCAAAATGTGCTGTATGAAA
ATCAGAAGCTGATTGCTAACCAATTCAATAGCGCCATTGGCAAGATCCAAGACTCTCTGAGCTCCACAGC
CAGCGCCCTCGGAAAGCTGCAAGACGTGGTGAATCAAAACGCCCAAGCTCTGAACACACTGGTGAAACAG
CTCAGCAGCAACTTTGGAGCCATCAGCAGCGTGCTCAATGATATCCTCTCTAGGCTGGACAAAGTGGAGG
CCGAAGTCCAGATCGATAGACTCATCACCGGCAGACTCCAATCTCTGCAGACATACGTCACCCAACAGCT
CATTAGAGCTGCCGAAATCAGAGCCTCCGCCAATCTGGCCGCCACCAAGATGTCCGAGTGCGTGCTGGGA
CAGAGCAAGAGAGTGGACTTCTGTGGCAAGGGATACCATCTGATGAGCTTCCCCCAGAGCGCTCCCCATG
GAGTGGTCTTTCTGCATGTCACATACGTGCCCGCCCAAGAGAAGAACTTCACCACCGCTCCCGCCATTTG
CCACGATGGAAAGGCCCACTTTCCCAGAGAAGGAGTGTTCGTGAGCAACGGCACACACTGGTTTGTCACC
CAGAGAAATTTTTACGAGCCCCAGATTATCACCACCGACAACACCTTCGTGTCCGGAAACTGCGATGTCG
TGATTGGCATCGTGAACAACACAGTCTACGACCCTCTGCAGCCCGAACTCGACAGCTTCAAGGAAGAGCT
GGACAAGTACTTCAAGAATCACACATCCCCCGACGTGGATCTGGGCGACATTAGCGGCATTAATGCCTCC
GTCGTCAACATTCAGAAGGAGATTGATAGACTGAATGAAGTCGCCAAGAACCTCAATGAGTCTCTGATTG
ATCTGCAAGAGCTGGGCAAGTACGAGCAATACATCAAATGGCCTTGGTACATCTGGCTGGGATTCATCGC
TGGACTCATCGCCATCGTGATGGTCACCATTATGCTGTGTTGCATGACCAGCTGCTGCAGCTGTCTGAAG
GGCTGCTGCAGCTGCGGAAGCTGCTGCAAGTTTGACGAAGACGACTCCGAGCCCGTGCTGAAGGGCGTCA
AGCTGCATTATACATAAACTAGTGCTGGAATTCGCCCTTATAGAGTGCTGGAATTCGCCCTTATAGAGTG
CTGGAATTCGCCCTTATATCTAGTAACGGCCGCCAGTGTGCTGGAATTCGCCCTTATAACTTCGTATAGC
ATACATTATACGAAGTTATTGTTGACAATTAATCATCGGCATAGTATATCGGCATAGTATAATACGACAA
GGTGAGGAACTAAACCATGGCCAAGTTGACCAGTGCCGTTCCGGTGCTCACCGCGCGCGACGTCGCCGGA
GCGGTCGAGTTCTGGACCGACCGGCTCGGGTTCTCCCGGGACTTCGTGGAGGACGACTTCGCCGGTGTGG
```

FIG. 53 (continued)

SEQ ID NO:28 (continued)

```
TCCGGGACGACGTGACCCTGTTCATCAGCGCGGTCCAGGACCAGGTGGTGCCGGACAACACCCTGGCCTG
GGTGTGGGTGCGCGGCCTGGACGAGCTGTACGCCGAGTGGTCGGAGGTCGTGTCCACGAACTTCCGGGAC
GCCTCCGGGCCGGCCATGACCGAGATCGGCGAGCAGCCGTGGGGCGGGAGTTCGCCCTGCGCGACCCGG
CCGGCAACTGCGTGCACTTCGTGGCCGAGGAGCAGGACTGAATAACTTCGTATAGCATACATTATACGAA
GTTATAAGGGCGAATTCTGCAGATATCCATCCTTTAAAAAACCTCCCACACCTCCCCCTGAACCTGAAAC
ATAAAATGAATGCAATTGTTGTTGTTAACTTGTTTATTGCAGCTTATAATGGTTACAAATAAAGCAATAG
CATCACAAATTTCACAAATAAAGCATTTTTTTCACTGCATTCTAGTTGTGGTTTGTCCAAACTCATCAAT
GTATCTTAACAACGTGTTTATTTTTCAATTGCAGAAAGAATTGCAGAAAATTTCAAGTCATTTTTCATTC
AGTAGTATAGCCCCACCACCACATAGCTTATACTAATCACCGTACCTTAATCAAACTCACAGAACCCTAG
TATTCAACCTGCCACCTCCCTCCCAACACACAGAGTACACAGTCCTTTCTCCCCGGCTGGCCTTAAACAG
CATCATATCATGGGTAACAGACATATTCTTAGGTGTTATATTCCACACGGTCTCCTGTCGAGCCAAACGC
TCATCAGTGATGTTAATAAACTCCCCGGGCAGCTCGCTTAAGTTCATGTCGCTGTCCAGCTGCTGAGCCA
CAGGCTGCTGTCCAACTTGCGGTTGCTCAACGGGCGGCGAAGGAGAAGTCCACGCCTACATGGGGGTAGA
GTCATAATCGTGCATCAGGATAGGGCGGTGGTGCTGCAGCAGCGCGCGAATAAACTGCTGCCGCCGCCGC
TCCGTCCTGCAGGAATACAACATGGCAGTGGTCTCCTCAGCGATGATTCGCACCGCCCGCAGCATAAGGC
GCCTTGTCCTCCGGGCACAGCAGCGCACCCTGATCTCACTTAAGTCAGCACAGTAACTGCAGCACAGTAC
CACAATATTGTTTAAAATCCCACAGTGCAAGGCGCTGTATCCAAAGCTCATGGCGGGGACCACAGAACCC
ACGTGGCCATCATACCACAAGCGCAGGTAGATTAAGTGGCGACCCCTCATAAACACGCTGGACATAAACA
TTACCTCTTTTGGCATGTTGTAATTCACCACCTCCCGGTACCATATAAACCTCTGATTAAACATGGCGCC
ATCCACCACCATCCTAAACCAGCTGGCCAAAACCTGCCCGCCGGCTATGCACTGCAGGGAACCGGGACTG
GAACAATGACAGTGGAGAGCCCAGGACTCGTAACCATGGATCATCATGCTCGTCATGATATCAATGTTGG
CACAACACAGGCACACGTGCATACACTTCCTCAGGATTACAAGCTCCTCCCGCGTCAGAACCATATCCCA
GGGAACAACCCATTCCTGAATCAGCGTAAATCCCACACTGCAGGGAAGACCTCGCACGTAACTCACGTTG
TGCATTGTCAAAGTGTTACATTCGGGCAGCAGCGGATGATCCTCCAGTATGGTAGCGCGTGTCTCTGTCT
CAAAAGGAGGTAGGCGATCCCTACTGTACGGAGTGCGCCGAGACAACCGAGATCGTGTTGGTCGTAGTGT
CATGCCAAATGGAACGCCGGACGTAGTCATATTTCCTGAAGCAAAACCAGGTGCGGGCGTGACAAACAGA
TCTGCGTCTCCGGTCTCGTCGCTTAGCTCGCTCTGTGTAGTAGTTGTAGTATATCCACTCTCTCAAAGCA
TCCAGGCGCCCCCTGGCTTCGGGTTCTATGTAAACTCCTTCATGCGCCGCTGCCCTGATAACATCCACCA
CCGCAGAATAAGCCACACCCAGCCAACCTACACATTCGTTCTGCGAGTCACACACGGGAGGAGCGGGAAG
AGCTGGAAGAACCATGTTTTTTTTTTTATTCCAAAAGATTATCCAAAACCTCAAAATGAAGATCTATTA
AGTGAACGCGCTCCCCTCCGGTGGCGTGGTCAAACTCTACAGCCAAAGAACAGATAATGGCATTTGTAAG
ATGTTGCACAATGGCTTCCAAAAGGCAAACTGCCCTCACGTCCAAGTGGACGTAAAGGCTAAACCCTTCA
NGGTGAATCTCCTCTATAAACATTCCAGCACCTTCAACCATGCCCAAATAATTTTCATCTCGCCACCTTA
TCAATATGTCTCTAAGCAAATCCCGAATATTAAGTCCGGCCATTGTAAAAATCTGCTCCAGAGCGCCCTC
CACCTTCAGCCTCAAGCAGCGAATCATGATTGCAAAAATTCAGGTTCCTCACAGACCTGTATAAGATTCA
AAAGCGGAACATTAACAAAAATACCGCGATCCCGTAGGTCCCTTCGCAGGGCCAGCTGAACATAATCGTG
CAGGTCTGCACGGACCAGCGCGGCCACTTCCCCGCCAGGAACCATGACAAAAGAACCCACACTGATTATG
ACACGCATACTCGGAGCTATGCTAACCAGCGTAGCCCCGATGTAAGCTTGTTGCATGGGCGGCGATATAA
AATGCAAGGTACTGCTCAAAAAATCAGGCAAAGCCTCGCGCAAAAAAGCAAGCACATCGTAGTCATGCTC
ATGCAGATAAAGGCAGGTAAGTTCCGGAACCACCACAGAAAAGACACCATTTTCTCTCAAACATGTCT
GCGGGTTCCTGCATAAACACAAAATAAAATAACAAAAAAAAAAAAACATTTAAACATTAGAAGCCTGTCT
TACAACAGGAAAAACAACCCTTATAAGCATAAGACGGACTACGGCCATGCCGGCGTGACCGTAAAAAAAC
TGGTCACCGTGATTAAAAAGCACCACCGACAGTTCCTCGGTCATGTCCGGAGTCATAATGTAAGACTCGG
TAAACACATCAGGTTGGTTAACATCGGTCAGTGCTAAAAAGCGACCGAAATAGCCCGGGGAATACATAC
CCGCAGGCGTAGAGACAACATTACAGCCCCCATAGGAGGTATAACAAAATTAATAGGAGAGAAAAACACA
TAAACCCCTGAAAAACCCTCCTGCCCCTAGGCAAAATAGCACCCTCCCGCTCCAGAACAACATACAGCGC
TTCCACAGCGGCAGCCATAACAGTCAGCCTTACCAGTAAAAAAACCTATTAAAAACACCACTCGACACG
GCACCAGCTCAATCAGTCACAGTGTAAAAAGGGCCAAGTACAGAGCGAGTATATATAGGACTAAAAAATG
ACGTAACGGTTAAAGTCCACAAAAACCACCCAGAAAACCGCACGCGAACCTACGCCCAGAAACGAAAGCC
AAAAAACCCACAACTTCCTCAAATCTTCACTTCCGTTTTCCCACGATACGTCACTTCCCATTTTAAAAAA
AAACTACAATTCCCAATACATGCAAGTTACTCCGCCCTAAAACCTACGTCACCCGCCCCGTTCCCACGCC
```

FIG. 53 (continued)

SEQ ID NO:28 (continued)

CCGCGCCACGTCACAAACTCCACCCCCTCATTATCATATTGGCTTCAATCCAAAATAAGGTATATTATTG
ATGATGGCGAT

FIG. 53 (continued)

SEQ ID NO:29

CGCCATCATCAATAATATACCTTATTTTGGATTGAAGCCAATATGATAATGAGGGGGTGGAGTTTGTGAC
GTGGCGCGGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTTACGTGGAGACTCGCCCAGGTGTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGGTAAAGAGGGAGCGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGTGGTTATTATGA
ATGTGAGGTTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGGTGGTGTGTCGCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC
GCACCAGGTGCAGACCCTGCGAGTGTGGCGGTAAACATATTAGGAACCAGCCTGTGATGCTGGATGTGAC

FIG. 54

SEQ ID NO:29 (continued)

```
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGGATATGAG
ATGCATCTTGGACTGTATTTTTAGGTTGGCTATGTTCCCAGCCATATCCCTCCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGGATCATGTCTACCTG
CGGGGCGATGAAGAAAACCGTTTCCGGGGTAGGGGAGATCAGCTGGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGGCCACTTCGTTAAGCATGTCCCTGACTTGCATGTTTTCCCT
GACCAAATCCGCCAGAAGGCGCTCGCCGCCCAGCGATAGCAGTTCTTGCAAGGAAGCAAAGTTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGGCGCCGCACGAGGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCTGGTCAGAAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGACCCCATGGCATGGGTGGGTGAGCGCGGAGGCG
TACATGCCGCAAATGTCGTAAACGTAGAGGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
CGCGCAGCTTGTTGACCAGCTCGGCGGTGACCTGCACGTCTAGGGCGCAGTAGTCCAGGGTTTCCTTGAT
```

SEQ ID NO:29 (continued)

```
GATGTCATACTTATCCTGTCCCTTTTTTTTCCACAGCTCGCGGTTGAGGACAAACTCTTCGCGGTCTTTC
CAGTACTCTTGGATCGGAAACCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAAGTCCGTGCGCTTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCCGCGGCGCGACTACGGTACCGCGCGG
CGGGCGGTGGGCCGCGGGGTGTCCTTGGATGATGCATCTAAAAGCGGTGACGCGGGCGGGCCCCCGGAG
GTAGGGGGGGCTCGGGACCCGCCGGGAGAGGGGGCAGGGGCACGTCGGCGCCGCGCGGGCAGGAGCTG
GTGCTGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCCAAGGCCTCAAGGCGCTCCATGGCCTCGTAGAAGTCCACGG
CGAAGTTGAAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGGCCTCTTCTTCTTCTTCAATCTCCTCTTCCATA
AGGGCCTCCCCTTCTTCTTCTTCTGGCGGCGGTGGGGGAGGGGGGACACGGCGGCGACGACGGCGCACCG
GGAGGCGGTCGACAAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAAGTGCGGCGGCGG
CTGGCGGTAGAGGGGCCAGCGTAGGGTGGCCGGGGCTCCGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
TAAATTCGCAAGGGTATCATGGCGGACGACCGGGGTTCGAACCCCGGATCCGGCCGTCCGCCGTGATCCA
```

FIG. 54 (continued)

SEQ ID NO:29 (continued)

```
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGTTTGACCCCGTCACTGGTCTTGTCATGCCTGGGGTATATA
CAAACGAAGCCTTCCATCCAGACATCATTTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCCGGTGGTGGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTTGGCGCGCCCGCCAGCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GGCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
ACACCCAGTGCGCGTGCGCGGGCACTACCGCGCGCCCTGGGGCGCGCACAAACGCGGCCGCACTGGGCGC
```

SEQ ID NO:29 (continued)

```
ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAAGAAGAGATGCTCCAGGTCATCGCGCCGGAGATCTA
TGGCCCCCCGAAGAAGGAAGAGCAGGATTACAAGCCCCGAAAGCTAAAGCGGGTCAAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCGAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCCGGCGTCCGCGCCGTTCAAGGAAGTACGGCGCCGCCAGCGCGCTACTGCCCGAATATGCCCT
ACATCCTTCCATCGCGCCTACCCCGGCTATCGTGGCTACACCTACCGCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAATAAAAGTCTGGACTCTCACGCTCGCTTGGTCCTGTAACTATTTT
GTAGAATGGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CCGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTTTGGGGTGCAATCCCTGAAGCGCCGACGATGCTTCTGATAGCTAACGTGT
CGTATGTGTGTCATGTATGCGTCCATGTCGCCGCCAGAGGAGCTGCTGAGCCGCCGCGCGCCCGCTTTCC
AAGATGGCTACCCCTTCGATGATGCCGCAGTGGTCTTACATGCACATCTCGGGCCAGGACGCCTCGGAGT
ACCTGAGCCCCGGGCTGGTGCAGTTCGCCCGCGCCACCGAGACGTACTTCAGCCTGAATAACAAGTTTAG
AAACCCCACGGTGGCGCCTACGCACGACGTGACCACAGACCGGTCTCAGCGTTTGACGCTGCGGTTCATC
CCCGTGGACCGCGAGGATACTGCGTACTCGTACAAGGCGCGGTTCACCCTAGCTGTGGGTGATAACCGTG
TGCTAGACATGGCTTCCACGTACTTTGACATCCGCGGCGTGCTGGACAGGGGCCCTACTTTTAAGCCCTA
CTCTGGCACTGCCTACAACGCACTGGCCCCAAGGGTGCCCCCAACTCGTGCGAGTGGGAACAAAATGAA
ACTGCACAAGTGGATGCTCAAGAACTTGACGAAGAGGAGAATGAAGCCAATGAAGCTCAGGCGCGAGAAC
AGGAACAAGCTAAGAAAACCCATGTATATGCCCAGGCTCCACTGTCCGGAATAAAAATAACTAAAGAAGG
TCTACAAATAGGAACTGCCGACGCCACAGTAGCAGGTGCCGGCAAAGAAATTTTCGCAGACAAAACTTTT
CAACCTGAACCACAAGTAGGAGAATCTCAATGGAACGAAGCGGATGCCACAGCAGCTGGTGGAAGGGTTC
TTAAAAAGACAACTCCCATGAAACCCTGCTATGGCTCATACGCTAGACCCACCAATTCCAACGGCGGACA
GGGCGTTATGGTTGAACAAAATGGTAAATTGGAAAGTCAAGTCGAAATGCAATTTTTTTCCACATCCACA
```

SEQ ID NO:29 (continued)

```
AATGCCACAAATGAAGTTAACAATATACAACCAACAGTTGTATTGTACAGCGAAGATGTAAACATGGAAA
CTCCAGATACTCATCTTTCTTATAAACCTAAAATGGGGGATAAAAATGCCAAAGTCATGCTTGGACAACA
AGCAATGCCAAACAGACCAAATTACATTGCTTTTAGAGACAATTTTATTGGTCTCATGTATTACAACAGC
ACAGGTAACATGGGTGTCCTTGCTGGTCAGGCATCGCAGTTGAACGCTGTTGTAGATTTGCAAGACAGAA
ACACAGAGCTGTCCTACCAGCTTTTGCTTGATTCAATTGGCGACAGAACAAGATACTTTTCAATGTGGAA
TCAAGCTGTTGACAGCTATGATCCAGATGTCAGAATTATTGAGAACCATGGAACTGAGGATGAGTTGCCA
AATTATTGCTTTCCTCTTGGTGGAATTGGGATTACTGACACTTTTCAAGCTGTTAAAACAACTGCTGCTA
ACGGGGACCAAGGCAATACTACCTGGCAAAAAGATTCAACATTTGCAGAACGCAATGAAATAGGGGTGGG
AAATAACTTTGCCATGGAAATTAACCTGAATGCCAACCTATGGAGAAATTTCCTTTACTCCAATATTGCG
CTGTACCTGCCAGACAAGCTAAAATACAACCCCACCAATGTGGAAATATCTGACAACCCCAACACCTACG
ACTACATGAACAAGCGAGTGGTGGCTCCTGGGCTTGTAGACTGCTACATTAACCTTGGGGCGCGCTGGTC
TCTGGACTACATGGACAACGTTAATCCCTTTAACCACCCCGCCATGCGGGCCTGCGTTACCGCTCCATG
TTGTTGGGAAACGGCCGCTACGTGCCCTTTCACATTCAGGTGCCCCAAAAGTTTTTTGCCATTAAAAACC
TCCTCCTCCTGCCAGGCTCATACACATATGAATGGAACTTCAGGAAGGATGTTAACATGGTTCTGCAGAG
CTCTCTGGGAAACGACCTTAGAGTTGACGGGGCTAGCATTAAGTTTGACAGCATTTGTCTTTACGCCACC
TTCTTCCCCATGGCCCACAACACGGCCTCCACGCTGGAAGCCATGCTCAGAAATGACACCAACGACCAGT
CCTTTAATGACTACCTTTCCGCCGCCAACATGCTATATCCCATACCCGCCAACGCCACCAACGTGCCCAT
CTCCATCCCATCGCGCAACTGGGCAGCATTTCGCGGTTGGGCCTTCACACGCTTGAAGACAAAGGAAACC
CCTTCCCTGGGATCAGGCTACGACCCTTACTACACCTACTCTGGCTCCATACCATACCTTGACGGAACCT
TCTATCTTAATCACACCTTTAAGAAGGTGGCCATTACTTTTGACTCTTCTGTTAGCTGGCCGGGCAACGA
CCGCCTGCTTACTCCCAATGAGTTTGAGATTAAGCGCTCAGTTGACGGGGAGGGCTATAACGTAGCTCAG
TGCAACATGACAAAGGACTGGTTCCTAGTGCAGATGTTGGCCAACTACAATATTGGCTACCAGGGCTTCT
ACATTCCAGAAAGCTACAAAGACCGCATGTACTCGTTCTTCAGAAACTTCCAGCCCATGAGCCGGCAAGT
GGTGGACGATACTAAATACAAAGATTATCAGCAGGTTGGAATTATCCACCAGCATAACAACTCAGGCTTC
GTAGGCTACCTCGCTCCCACCATGCGCGAGGGACAAGCTTACCCCGCTAATGTTCCCTACCCACTAATAG
GCAAAACCGCGGTTGATAGTATTACCCAGAAAAAGTTTCTTTGCGACCGCACCCTGTGGCGCATCCCCTT
CTCCAGTAACTTTATGTCCATGGGTGCGCTCACAGACCTGGGCCAAAACCTTCTCTACGCAAACTCCGCC
CACGCGCTAGACATGACCTTTGAGGTGGATCCCATGGACGAGCCCACCCTTCTTTATGTTTTGTTTGAAG
TCTTTGACGTGGTCCGTGTGCACCAGCCGCACCGCGGCGTCATCGAGACCGTGTACCTGCGCACGCCCTT
CTCGGCCGGCAACGCCACAACATAAAGAAGCAAGCAACATCAACAACAGCTGCCGCCATGGGCTCCAGTG
AGCAGGAACTGAAAGCCATTGTCAAAGATCTTGGTTGTGGGCCATATTTTTGGGCACCTATGACAAGCG
CTTCCCAGGCTTTGTTTCCCCACACAAGCTCGCCTGCGCCATAGTTAACACGGCCGGTCGCGAGACTGGG
GGCGTACACTGGATGGCCTTTGCCTGGAACCCGCGCTCAAAAACATGCTACCTCTTTGAGCCCTTTGGCT
TTTCTGACCAACGTCTCAAGCAGGTTTACCAGTTTGAGTACGAGTCACTCCTGCGCCGTAGCGCCATTGC
CTCTTCCCCCGACCGCTGTATAACGCTGGAAAAGTCCACCCAAAGCGTGCAGGGGCCCAACTCGGCCGCC
TGTGGCCTATTCTGCTGCATGTTTCTCCACGCCTTTGCCAACTGGCCCCAAACTCCCATGGATCACAACC
CCACCATGAACCTTATTACCGGGGTACCCAACTCCATGCTTAACAGTCCCCAGGTACAGCCCACCCTGCG
CCGCAACCAGGAACAGCTCTACAGCTTCCTGGAGCGCCACTCGCCCTACTTCCGCAGCCACAGTGCGCAA
ATTAGGAGCGCCACTTCTTTTTGTCACTTGAAAAACATGTAAAAATAATGTACTAGGAGACACTTTCAAT
AAAGGCAAATGTTTTTATTTGTACACTCTCGGGTGATTATTTACCCCCACCCTTGCCGTCTGCGCCGTTT
AAAAATCAAAGGGGTTCTGCCGCGCATCGCTATGCGCCACTGGCAGGGACACGTTGCGATACTGGTGTTT
AGTGCTCCACTTAAACTCAGGCACAACCATCCGCGGCAGCTCGGTGAAGTTTTCACTCCACAGGCTGCGC
ACCATCACCAACGCGTTTAGCAGGTCGGGCGCCGATATCTTGAAGTCGCAGTTGGGGCCTCCGCCCTGCG
CGCGCGAGTTGCGATACACAGGGTTACAGCACTGGAACACTATCAGCGCCGGGTGGTGCACGCTGGCCAG
CACGCTCTTGTCGGAGATCANATCCGCGTCCAGGTCCTCCGCGTTGCTCAGGGCGAACGGAGTCAACTTT
GGTAGCTGCCTTCCCAAAAAGGGTGCATGCCCAGGCTTTGAGTTGCACTCGCACCGTAGTGGCATCAGAA
GGTGACCGTGCCCAGTCTGGGCGTTAGGATACAGCGCCTGCATGAAAGCCTTGATCTGCTTAAAAGCCAC
CTGAGCCTTTGCGCCTTCAGAGAAGAACATGCCGCAAGACTTGCCGGAAAACTGATTGGCCGGACAGGCC
GCGTCATGCACGCAGCACCTTGCGTCGGTGTTGGAGATCTGCACCACATTTCGGCCCCACCGGTTCTTCA
CGATCTTGGCCTTGCTAGACTGCTCCTTCAGCGCGCGCTGCCCGTTTTCGCTCGTCACATCCATTTCAAT
CACGTGCTCCTTATTTATCATAATGCTCCCGTGTAGACACTTAAGCTCGCCTTCGATCTCAGCGCAGCGG
TGCAGCCACAACGCGCAGCCCGTGGGCTCGTGGTGCTTGTAGGTTACCTCTGCAAACGACTGCAGGTACG
```

FIG. 54 (continued)

SEQ ID NO:29 (continued)

CCTGCAGGAATCGCCCCATCATCGTCACAAAGGTCTTGTTGCTGGTGAAGGTCAGCTGCAACCCGCGGTG
CTCCTCGTTTAGCCAGGTCTTGCATACGGCCGCCAGAGCTTCCACTTGGTCAGGCAGTAGCTTGAAGTTT
GCCTTTAGATCGTTATCCACGTGGTACTTGTCCATCAACGCGCGCGCAGCCTCCATGCCCTTCTCCCACG
CAGACACGATCGGCAGGCTCAGCGGGTTTATCACCGTGCTTTCACTTTCCGCTTCACTGGACTCTTCCTT
TTCCTCTTGCATCCGCATACCCCGCGCCACTGGGTCGTCTTCATTCAGCCGCCGCACCGTGCGCTTACCT
CCCTTGCCGTGCTTGATTAGCACCGGTGGGTTGCTGAAACCCACCATTTGTAGCGCCACATCTTCTCTTT
CTTCCTCGCTGTCCACGATCACCTCTGGGGATGGCGGGCGCTCGGGCTTGGGAGAGGGGCGCTTCTTTTT
CTTTTTGGACGCAATGGCCAAATCCGCCGTCGAGGTCGATGGCCGCGGGCTGGGTGTGCGCGGCACCAGC
GCATCTTGTGACGAGTCTTCTTCGTCCTCGGACTCGAGACGCCGCCTCAGCCGCTTTTTGGGGCGCGC
GGGGAGGCGGCGGCGACGGCGACGGGGACGAGACGTCCTCCATGGTTGGTGGACGTCGCGCCGCACCGCG
TCCGCGCTCGGGGGTGGTTTCGCGCTGCTCCTCTTCCCGACTGGCCATTTCCTTCTCCTATAGGCAGAAA
AAGATCATGGAGTCAGTCGAGAAGGAGGACAGCCTAACCGCCCCCTTTGAGTTCGCCACCACCGCCTCCA
CCGATGCCGCCAACGCGCCTACCACCTTCCCCGTCGAGGCACCCCGCTTGAGGAGGAGGAAGTGATTAT
CGAGCAGGACCCAGGTTTTGTAAGCGAAGACGACGAAGATCGCTCAGTACCAACAGAGGATAAAAGCAA
GACCAGGACGACGCAGAGGCAAACGAGGAACAAGTCGGGCGGGGGACCAAAGGCATGGCGACTACCTAG
ATGTGGGAGACGACGTGCTGTTGAAGCATCTGCAGCGCCAGTGCGCCATTATCTGCGACGCGTTGCAAGA
GCGCAGCGATGTGCCCCTCGCCATAGCGGATGTCAGCCTTGCCTACGAACGCCACCTGTTCTCACCGCGC
GTACCCCCAAACGCCAAGAAAACGGCACATGCGAGCCCAACCCGCGCCTCAACTTCTACCCCGTATTTG
CCGTGCCAGAGGTGCTTGCCACCTATCACATCTTTTTCCAAAACTGCAAGATACCCCTATCCTGCCGTGC
CAACCGCAGCCGAGCGGACAAGCAGCTGGCCTTGCGGCAGGGCGCTGTCATACCTGATATCGCCTCGCTC
GACGAAGTGCCAAAAATCTTTGAGGGTCTTGGACGCGACGAGAAGCGCGCGGCAAACGCTCTGCAACAAG
AAAACAGCGAAAATGAAAGTCACTGTGGAGTGCTGGTGGAACTTGAGGGTGACAACGCGCGCCTAGCCGT
GCTGAAACGCAGCATCGAGGTCACCCACTTTGCCTACCCGGCACTTAACCTACCCCCAAGGTTATGAGC
ACAGTCATGAGCGAGCTGATCGTGCGCCGTGCACGACCCTGGAGAGGGATGCAAACTTGCAAGAACAAA
CCGAGGAGGGCCTACCCGCAGTTGGCGATGAGCAGCTGGCGCGCTGGCTTGAGACGCGCGAGCCTGCCGA
CTTGGAGGAGCGACGCAAGCTAATGATGGCCGCAGTGCTTGTTACCGTGGAGCTTGAGTGCATGCAGCGG
TTCTTTGCTGACCCGGAGATGCAGCGCAAGCTAGAGGAAACGTTGCACTACACCTTTCGCCAGGGCTACG
TGCGCCAGGCCTGCAAAATTTCCAACGTGGAGCTCTGCAACCTGGTCTCCTACCTTGGAATTTTGCACGA
AAACCGCCTTGGGCAAAACGTGCTTCATTCCACGCTCAAGGGCGAGGCGCGCCGCGACTACGTCCGCGAC
TGCGTTTACTTATTTCTGTGCTACACCTGGCAAACGGCCATGGGCGTGTGGCAGCAGTGCCTGGAGGAGC
GCAACCTGAAGGAGCTGCAGAAGCTGCTAAAGCAAAACTTGAAGGACCTATGGACGGCCTTCAACGAGCG
CTCCGTGGCCGCGCACCTGGCGGACATTATCTTCCCCGAACGCCTGCTTAAAACCCTGCAACAGGGTCTG
CCAGACTTCACCAGTCAAAGCATGTTGCAAAACTTTAGGAACTTTATCCTAGAGCGTTCAGGAATTCTGC
CCGCCACCTGCTGTGCGCTTCCTAGCGACTTTGTGCCCATTAAGTACCGTGAATGCCCTCCGCCGCTTTG
GGGTCACTGCTACCTTNTGCAGCTAGCCAACTACCTTGCCTACCACTCCGACATCATGGAAGACGTGAGC
GGTGACGGCCTACTGGAGTGTCACTGTCGCTGCAACCTATGCACCCCGCACCGCTCCTGGTCTGCAATT
CACAACTGCTTAGCGAAAGTCAAATTATCGGTACCTTTGAGCTGCAGGGTCCCTCGCCTGACGAAAAGTC
CGCGGCTCCGGGGTTGAAACTCACTCCGGGGCTGTGGACGTCGGCTTACCTTCGCAAATTTGTACCTGAG
GACTACCACGCCCACGAGATTAGGTTCTACGAAGACCAATCCCGCCCGCCAAATGCGGAGCTTACCGCCT
GCGTCATTACCCAGGGCACATCCTTGGCCAATTGCAAGCCATTAACAAAGCCCGCCAAGAGTTTCTGCT
ACGAAAGGGACGGGGGTTTACTTGGACCCCCAGTCCGGCGAGGAGCTCAACCCAATCCCCCGCCGCCG
CAGCCCTATCAGCAGCCGCGGGCCCTTGCTTCCCAGGATGGCACCCAAAAAGAAGCTGCAGCTGCCGCCG
CCGCCACCCACGGACGAGGAGGAATACTGGGACAGTCAGGCAGAGGAGGTTTTGGACGAGGAGGAGGAGA
TGATGGAAGACTGGGACAGCCTAGACGAGGAAGCTTCCGAGGCCGAAGAGGTGTCAGACGAAACACCGTC
ACCCTCGGTCGCATTCCCTCGCCGGCGCCCCAGAAATCGGCAACCGTTCCCAGCATTGCTACAACCTCC
GCTCCTCAGGCGCCGCCGGCACTGCCCGTTCGCCGACCCAACCGTAGATGGGACACCACTGGAACCAGGG
CCGGTAAGTCTAAGCAGCCGCCGCCGTTAGCCCAAGAGCAACAACAGCGCCAAGGCTACCGCTCGTGGCG
CGTGCACAAGAACGCCATAGTTGCTTGCTTGCAAGACTGTGGGGCAACATCTCCTTCGCCCGCCGCTTT
CTTCTCTACCATCACGGCGTGGCCTTCCCCCGTAACATCCTGCATTACTACCGTCATCTCTACAGCCCCT
ACTGCACCGGCGGCAGCGGCAGCAACAGCAGCGGCCACGCAGAAGCAAAGGCGACCGGATAGCAAGACTC
TGACAAAGCCCAAGAAATCCACAGCGGCGGCAGCAGCAGGAGGAGGAGCACTGCGTCTGGCGCCCAACGA
ACCCGTATCGACCCGCGAGCTTAGAAACAGGATTTTTCCCACTCTGTATGCTATATTTCAACAGAGCAGG

FIG. 54 (continued)

SEQ ID NO:29 (continued)

```
GGCCAAGAACAAGAGCTGAAAATAAAAAACAGGTCTCTGCGCTCCCTCACCCGCAGCTGCCTGTATCACA
AAAGCGAAGATCAGCTTCGGCGCACGCTGGAAGACGCGGAGGCTCTCTTCAGCAAATACTGCGCGCTGAC
TCTTAAGGACTAGTTTCGCGCCCTTTCTCAAATTTAAGCGCGAAAACTACGTCATCTCCAGCGGCCACAC
CCGGCGCCAGCACCTGTCGTCAGCGCCATTATGAGCAAGGAAATTCCCACGCCCTACATGTGGAGTTACC
AGCCACAAATGGGACTTGCGGCTGGAGCTGCCCAAGACTACTCAACCCGAATAAACTACATGAGCGCGGG
ACCCCACATGATATCCCGGGTCAACGGAATCCGCGCCCACCGAAACCGAATTCTCCTCGAACAGGCGGCT
ATTACCACCACACCTCGTAATAACCTTAATCCCCGTAGTTGGCCCGCTGCCCTGGTGTACCAGGAAAGTC
CCGCTCCCACCACTGTGGTACTTCCCAGAGACGCCCAGGCCGAAGTTCAGATGACTAACTCAGGGGCGCA
GCTTGCGGGCGGCTTTCGTCACAGGGTGCGGTCGCCCGGGCAGGGTATAACTCACCTGAAAATCAGAGGG
CGAGGTATTCAGCTCAACGACGAGTCGGTGAGCTCCTCTCTTGGTCTCCGTCCGGACGGGACATTTCAGA
TCGGCGGCGCTGGCCGCTCTTCATTTACGCCCGTCAGGCGATCCTAACTCTGCAGACCTCGTCCTCGGA
GCCGCGCTCCGGAGGCATTGGAACTCTACAATTTATTGAGGAGTTCGTGCCTTCGGTTTACTTCAACCCC
TTTTCTGGACCTCCCGGCCACTACCCGGACCAGTTTATTCCCAACTTTGACGCGGTAAAAGACTCGGCGG
ACGGCTACGACTGACAGATCTGAGCTCGCGGCCGCGATATCGCTAGCGAAGTTCCTATTCTCTAGAAAGT
ATAGGAACTTCGATCCTCTAGAGTCGACCTGCAGGCATGCAAGCTTGGCACTGCAATAAATTACTTACTT
AAAATCAGTCAGCAAATCTTTGTCCAGCTTATTCAGCATCACCTCCTTTCCTCCTCCCAACTCTGGTAT
TTCAGCAGCCTTTTAGCTGCGAACTTTCTCCAAAGTCTAAATGGGATGTCAAATTCCTCATGTTCTTGTC
CCTCCGCACCCACTATCTTCATATTGTTGCAGATGAAACGCGCCAGACCGTCTGAAGACACCTTCAACCC
TGTGTACCCATATGACACGGAAACCGGCCCTCCAACTGTGCCTTTCCTTACCCCTCCCTTTGTGTCGCCA
AATGGGTTCCAAGAAAGTCCCCCCGGAGTGCTTTCTTTGCGTCTTTCAGAACCTTTGGTTACCTCACACG
GCATGCTTGCGCTAAAAATGGGCAGCGGCCTGTCCCTGGATCAGGCAGGCAACCTTACATCAAATACAAT
CACTGTTTCTCAACCGCTAAAAAAACAAAGTCCAATATAACTTTGGAAACATCCGCGCCCCTTACAGTC
AGCTCAGGCGCCCTAACCATGGCCACAACTTCGCCTTTGGTGGTCTCTGACAACACTCTTACCATGCAAT
CACAAGCACCGCTAACCGTGCAAGACTCAAAACTTAGCATTGCTACCAAGAGCCACTTACAGTGTTAGA
TGGAAAACTGGCCCTGCAGACATCAGCCCCCTCTCTGCCACTGATAACAACGCCCTCACTATCACTGCC
TCACCTCCTCTTACTACTGCAAATGGTAGTCTGGCTGTTACCATGGAAAACCCACTTTACAACAACAATG
GAAAACTTGGGCTCAAAATTGGCGGTCCTTTGCAAGTGGCCACCGACTCACATGCACTAACACTAGGTAC
TGGTCAGGGGGTTGCAGTTCATAACAATTTGCTACATACAAAAGTTACAGGCGCAATAGGGTTTGATACA
TCTGGCAACATGGAACTTAAAACTGGAGATGGCCTCTATGTGGATAGCGCCGGTCCTAACCAAAAACTAC
ATATTAATCTAAATACCACAAAAGGCCTTGCTTTTGACAACACCGCAATAACAATTAACGCTGGAAAAGG
GTTGGAATTTGAAACAGACTCCTCAAACGGAAATCCCATAAAAACAAAAATTGGATCAGGCATACAATAT
AATACCAATGGAGCTATGGTTGCAAAACTTGGAACAGGCCTCAGTTTTGACAGCTCCGGAGCCATAACAA
TGGGCAGCATAAACAATGACAGACTTACTCTTTGGACAACACCAGACCCATCCCCAAATTGCAGAATTGC
TTCAGATAAAGACTGCAAGCTAACTCTGGCGCTAACAAAATGTGGCAGTCAAATTTTGGGCACTGTTTCA
GCTTTGGCAGTATCAGGTAATATGGCCTCCATCAATGGAACTCTAAGCAGTGTAAACTTGGTTCTTAGAT
TTGATGACAACGGAGTGCTTATGTCAAATTCATCACTGGACAAACAGTATTGGAACTTTAGAAACGGGGA
CTCCACTAACGGTCAACCATACACTTATGCTGTTGGGTTTATGCCAAACCTAAAAGCTTACCCAAAAACT
CAAAGTAAAACTGCAAAAGTAATATTGTTAGCCAGGTGTATCTTAATGGTGACAAGTCTAAACCATTGC
ATTTTACTATTACGCTAAATGGAACAGATGAAACCAACCAAGTAAGCAAATACTCAATATCATTCAGTTG
GTCCTGGAACAGTGGACAATACACTAATGACAAATTTGCCACCAATTCCTATACCTTCTCCTACATTGCC
CAGGAATAAAGAATCGTGAACCTGTTGCATGTTATGTTTCAACGTGTTTATTTTTCAATTCGTATTAGTC
ATCGCTATTACCATGGTGATGCGGTTTTGGCAGTACATCAATGGGCGTGGATAGCGGTTTGACTCACGGG
GATTTCCAAGTCTCCACCCCATTGACGTCAATGGGAGTTTGTTTTGGCACCAAAATCAACGGGACTTTCC
AAAATGTCGTAACAACTCCGCCCCATTGACGCAAATGGGCGGTAGGCGTGTACGGTGGGAGGTCTATATA
AGCAGAGCTGGTTTAGTGAACCGTCAGATCCGCTAGAGATCCACCATGTTTGTCTTTCTCGTGCTGCTGC
CCCTCGTGAGCAGCCAGTGCGTCAATCTGACAACAAGGACCCAGCTGCCCCCGCCTACACCAACTCCTT
CACAAGAGGCGTGTATTACCCCGATAAGGTCTTCAGATCCAGCGTCCTCCACAGCACCCAAGATTTGTTT
CTGCCTTTCTTCAGCAACGTGACATGGTTCCACGCCATTCATGTCAGCGGCACAAACGGCACAAGAGGT
TTGACAACCCCGTGCTCCCCTTCAACGACGGCGTGTACTTCGCCAGCACAGAGAAATCCAATATCATTAG
GGGCTGGATCTTCGGCACAACACTGGATTCCAAGACCCAGTCTCTGCTCATTGTGAATAACGCCACCAAC
GTGGTGATTAAGGTCTGTGAGTTTCAGTTCTGCAACGACCCCTTTCTGGGAGTCTACTACCACAAGAATA
ATAAGAGCTGGATGGAGTCCGAGTTTAGGGTGTACAGCTCCGCCAACAACTGTACCTTCGAATACGTGTC
```

SEQ ID NO:29 (continued)

```
CCAGCCTTTCCTCATGGATCTGGAGGGCAAGCAAGGCAATTTCAAAAATCTGAGAGAGTTCGTGTTCAAA
AACATTGATGGATACTTCAAAATCTACAGCAAGCATACCCCCATTAATCTGGTGAGGGATCTGCCCCAAG
GATTCTCCGCTCTGGAACCTCTGGTGGATCTGCCCATTGGCATTAACATCACAAGATTCCAGACCCTCCT
CGCCCTCCATAGATCCTATCTGACCCCCGGCGACTCCTCCAGCGGATGGACAGCCGGAGCTGCCGCCTAC
TACGTGGGCTATCTGCAGCCAAGAACCTTTCTGCTGAAGTACAACGAGAACGGCACCATCACAGACGCTG
TCGATTGCGCTCTCGACCCTCTGAGCGAGACCAAATGCACACTGAAGAGCTTCACCGTGGAAAAGGGCAT
CTATCAGACCAGCAACTTCAGAGTGCAGCCTACCGAGAGCATTGTGAGGTTTCCCAACATCACCAATCTG
TGTCCTTTCGGCGAGGTCTTTAATGCCACAAGGTTCGCTTCCGTGTATGCTTGGAATAGGAAGAGGATCA
GCAATTGCGTCGCCGACTATTCCGTCCTCTATAACAGCGCCTCCTTCTCCACCTTCAAATGTTATGGCGT
GTCCCCCACCAAGCTCAACGACCTCTGCTTCACCAATGTGTACGCTGACTCCTTCGTCATTAGGGGCGAC
GAGGTGAGGCAAATTGCCCCCGGCCAGACCGGCAAGATTGCTGATTACAACTACAAACTGCCCGACGATT
TTACCGGCTGCGTGATCGCTTGGAACTCCAACAATCTGGACTCCAAAGTGGGCGGAAACTACAATTACCT
CTACAGACTCTTTAGAAAAAGCAATCTGAAGCCCTTCGAGAGAGACATCTCCACCGAAATCTACCAAGCC
GGAAGCACACCTTGCAATGGCGTCGAGGGATTTAACTGCTACTTCCCTCTGCAGAGCTACGGCTTTCAAC
CTACCAACGGCGTCGGATATCAACCCTATAGGGTGGTCGTGCTGAGCTTTGAACTGCTGCATGCTCCCGC
CACCGTCTGCGGACCTAAGAAGAGCACCAATCTCGTCAAAAACAAGTGCGTGAACTTCAACTTCAATGGA
CTGACCGGCACCGGCGTGCTGACCGAGAGCAATAAGAAGTTTCTGCCCTTCCAGCAGTTCGGAAGGGATA
TTGCCGATACCACAGATGCTGTGAGGGACCCCCAAACCCTCGAGATTCTGGATATCACCCCTTGCAGCTT
CGGAGGAGTGTCCGTGATCACCCCCGGAACAAACACCTCCAATCAAGTGGCTGTGCTGTACCAAGACGTG
AACTGCACAGAAGTCCCCGTGGCCATCCATGCCGACCAGCTGACCCCTACATGGAGAGTGTACTCCACCG
GCAGCAATGTGTTCCAGACAAGAGCCGGATGCCTCATTGGAGCTGAACACGTCAACAACAGCTACGAGTG
CGACATTCCCATCGGCGCCGGCATTTGTGCCTCCATCAGACCCAGACCAACAGCCCAAGAAGGGCTAGA
AGCGTCGCTTCCCAATCCATCATTGCCTACACCATGTCTCTGGGAGCCGAAAACTCCGTCGCCTACTCCA
ACAATAGCATCGCCATCCCCACCAATTTTACCATCTCCGTGACCACAGAGATTCTGCCCGTGTCCATGAC
AAAGACATCCGTGGACTGCACCATGTACATCTGTGGCGACAGCACCGAGTGTAGCAATCTGCTGCTGCAA
TATGGCAGCTTCTGCACCCAGCTGAACAGAGCCCTCACCGGCATCGCCGTCGAACAAGACAAGAACACCC
AAGAGGTGTTCGCCCAAGTGAAGCAAATCTACAAGACCCCCCCTATCAAAGATTTCGGAGGATTCAACTT
TAGCCAGATTCTGCCCGATCCTAGCAAGCCTTCCAAGAGGAGCTTCATCGAGGATCTGCTGTTTAATAAG
GTGACACTGGCCGACGCTGGCTTCATTAAACAGTACGGCGATTGTCTGGGCGACATCGCTGCTAGGGATC
TGATCTGCGCTCAGAAGTTCAACGGACTGACAGTCCTCCCTCCTCTGCTGACCGACGAGATGATCGCTCA
GTATACCAGCGCTCTGCTGGCTGGAACCATTACCAGCGGCTGGACATTCGGCGCTGGAGCCGCCCTCCAA
ATTCCCTTTGCCATGCAGATGGCCTATAGATTCAACGGCATTGGCGTCACCCAAAATGTGCTGTATGAAA
ATCAGAAGCTGATTGCTAACCAATTCAATAGCGCCATTGGCAAGATCCAAGACTCTCTGAGCTCCACAGC
CAGCGCCCTCGGAAAGCTGCAAGACGTGGTGAATCAAAACGCCCAAGCTCTGAACACACTGGTGAAACAG
CTCAGCAGCAACTTTGGAGCCATCAGCAGCGTGCTCAATGATATCCTCTCTAGGCTGGACCCTCCGGAGG
CCGAAGTCCAGATCGATAGACTCATCACCGGCAGACTCCAATCTCTGCAGACATACGTCACCCAACAGCT
CATTAGAGCTGCCGAAATCAGAGCCTCCGCCAATCTGGCCGCCACCAAGATGTCCGAGTGCGTGCTGGGA
CAGAGCAAGAGAGTGGACTTCTGTGGCAAGGGATACCATCTGATGAGCTTCCCCCAGAGCGCTCCCCATG
GAGTGGTCTTTCTGCATGTCACATACGTGCCCGCCCAAGAGAAGAACTTCACCACCGCTCCCGCCATTTG
CCACGATGGAAAGGCCCACTTTCCCAGAGAAGGAGTGTTCGTGAGCAACGGCACACACTGGTTTGTCACC
CAGAGAAATTTTTACGAGCCCCAGATTATCACCACCGACAACACCTTCGTGTCCGGAAACTGCGATGTCG
TGATTGGCATCGTGAACAACACAGTCTACGACCCTCTGCAGCCCGAACTCGACAGCTTCAAGGAAGAGCT
GGACAAGTACTTCAAGAATCACACATCCCCCGACGTGGATCTGGGCGACATTAGCGGCATTAATGCCTCC
GTCGTCAACATTCAGAAGGAGATTGATAGACTGAATGAAGTCGCCAAGAACCTCAATGAGTCTCTGATTG
ATCTGCAAGAGCTGGGCAAGTACGAGCAATACATCAAATGGCCTTGGTACATCTGGCTGGGATTCATCGC
TGGACTCATCGCCATCGTGATGGTCACCATTATGCTGTGTTGCATGACCAGCTGCTGCAGCTGTCTGAAG
GGCTGCTGCAGCTGCGGAAGCTGCTGCAAGTTTGACGAAGACGACTCCGAGCCCGTGCTGAAGGGCGTCA
AGCTGCATTATACATAAACTAGTGCTGGAATTCGCCCTTATAGAGTGCTGGAATTCGCCCTTATAGAGTG
CTGGAATTCGCCCTTATATCTAGTAACGGCCGCCAGTGTGCTGGAATTCGCCCTTATAACTTCGTATAGC
ATACATTATACGAAGTTATTGTTGACAATTAATCATCGGCATAGTATATCGGCATAGTATAATACGACAA
GGTGAGGAACTAAACCATGGCCAAGTTGACCAGTGCCGTTCCGGTGCTCACCGCGCGCGACGTCGCCGGA
GCGGTCGAGTTCTGGACCGACCGGCTCGGGTTCTCCGGGACTTCGTGGAGGACGACTTCGCCGGTGTGG
```

FIG. 54 (continued)

SEQ ID NO:29 (continued)

```
TCCGGGACGACGTGACCCTGTTCATCAGCGCGGTCCAGGACCAGGTGGTGCCGGACAACACCCTGGCCTG
GGTGTGGGTGCGCGGCCTGGACGAGCTGTACGCCGAGTGGTCGGAGGTCGTGTCCACGAACTTCCGGGAC
GCCTCCGGGCCGGCCATGACCGAGATCGGCGAGCAGCCGTGGGGCGGGAGTTCGCCCTGCGCGACCCGG
CCGGCAACTGCGTGCACTTCGTGGCCGAGGAGCAGGACTGAATAACTTCGTATAGCATACATTATACGAA
GTTATAAGGGCGAATTCTGCAGATATCCATCCTTTAAAAAACCTCCCACACCTCCCCCTGAACCTGAAAC
ATAAAATGAATGCAATTGTTGTTGTTAACTTGTTTATTGCAGCTTATAATGGTTACAAATAAAGCAATAG
CATCACAAATTTCACAAATAAAGCATTTTTTTCACTGCATTCTAGTTGTGGTTTGTCCAAACTCATCAAT
GTATCTTAACAACGTGTTTATTTTTCAATTGCAGAAAGAATTGCAGAAAATTTCAAGTCATTTTTCATTC
AGTAGTATAGCCCCACCACCACATAGCTTATACTAATCACCGTACCTTAATCAAACTCACAGAACCCTAG
TATTCAACCTGCCACCTCCCTCCCAACACACAGAGTACACAGTCCTTTCTCCCCGGCTGGCCTTAAACAG
CATCATATCATGGGTAACAGACATATTCTTAGGTGTTATATTCCACACGGTCTCCTGTCGAGCCAAACGC
TCATCAGTGATGTTAATAAACTCCCGGGCAGCTCGCTTAAGTTCATGTCGCTGTCCAGCTGCTGAGCCA
CAGGCTGCTGTCCAACTTGCGGTTGCTCAACGGGCGGCGAAGGAGAAGTCCACGCCTACATGGGGGTAGA
GTCATAATCGTGCATCAGGATAGGGCGGTGGTGCTGCAGCAGCGCGCGAATAAACTGCTGCCGCCGCCGC
TCCGTCCTGCAGGAATACAACATGGCAGTGGTCTCCTCAGCGATGATTCGCACCGCCCGCAGCATAAGGC
GCCTTGTCCTCCGGGCACAGCAGCGCACCCTGATCTCACTTAAGTCAGCACAGTAACTGCAGCACAGTAC
CACAATATTGTTTAAAATCCCACAGTGCAAGGCGCTGTATCCAAAGCTCATGGCGGGGACCACAGAACCC
ACGTGGCCATCATACCACAAGCGCAGGTAGATTAAGTGGCGACCCCTCATAAACACGCTGGACATAAACA
TTACCTCTTTTGGCATGTTGTAATTCACCACCTCCCGGTACCATATAAACCTCTGATTAAACATGGCGCC
ATCCACCACCATCCTAAACCAGCTGGCCAAAACCTGCCCGCCGGCTATGCACTGCAGGGAACCGGGACTG
GAACAATGACAGTGGAGAGCCCAGGACTCGTAACCATGGATCATCATGCTCGTCATGATATCAATGTTGG
CACAACACAGGCACACGTGCATACACTTCCTCAGGATTACAAGCTCCTCCCGCGTCAGAACCATATCCCA
GGGAACAACCCATTCCTGAATCAGCGTAAATCCCACACTGCAGGGAAGACCTCGCACGTAACTCACGTTG
TGCATTGTCAAAGTGTTACATTCGGGCAGCAGCGGATGATCCTCCAGTATGGTAGCGCGTGTCTCTGTCT
CAAAAGGAGGTAGGCGATCCCTACTGTACGGAGTGCGCCGAGACAACCGAGATCGTGTTGGTCGTAGTGT
CATGCCAAATGGAACGCCGGACGTAGTCATATTTCCTGAAGCAAAACCAGGTGCGGGCGTGACAAACAGA
TCTGCGTCTCCGGTCTCGTCGCTTAGCTCGCTCTGTGTAGTAGTTGTAGTATATCCACTCTCTCAAAGCA
TCCAGGCGCCCCCTGGCTTCGGGTTCTATGTAAACTCCTTCATGCGCCGCTGCCCTGATAACATCCACCA
CCGCAGAATAAGCCACACCCAGCCAACCTACACATTCGTTCTGCGAGTCACACACGGGAGGAGCGGGAAG
AGCTGGAAGAACCATGTTTTTTTTTTTATTCCAAAAGATTATCCAAAACCTCAAAATGAAGATCTATTA
AGTGAACGCGCTCCCCTCCGGTGGCGTGGTCAAACTCTACAGCCAAAGAACAGATAATGGCATTTGTAAG
ATGTTGCACAATGGCTTCCAAAAGGCAAACTGCCCTCACGTCCAAGTGGACGTAAAGGCTAAACCCTTCA
NGGTGAATCTCCTCTATAAACATTCCAGCACCTTCAACCATGCCCAAATAATTTTCATCTCGCCACCTTA
TCAATATGTCTCTAAGCAAATCCCGAATATTAAGTCCGGCCATTGTAAAAATCTGCTCCAGAGCGCCCTC
CACCTTCAGCCTCAAGCAGCGAATCATGATTGCAAAAATTCAGGTTCCTCACAGACCTGTATAAGATTCA
AAAGCGGAACATTAACAAAAATACCGCGATCCCGTAGGTCCCTTCGCAGGGCCAGCTGAACATAATCGTG
CAGGTCTGCACGGACCAGCGCGGCCACTTCCCCGCCAGGAACCATGACAAAAGAACCCACACTGATTATG
ACACGCATACTCGGAGCTATGCTAACCAGCGTAGCCCCGATGTAAGCTTGTTGCATGGGCGGCGATATAA
AATGCAAGGTACTGCTCAAAAAATCAGGCAAAGCCTCGCGCAAAAAGCAAGCACATCGTAGTCATGCTC
ATGCAGATAAAGGCAGGTAAGTTCCGGAACCACCACAGAAAAGACACCATTTTTCTCTCAAACATGTCT
GCGGGTTCCTGCATAAACACAAAATAAAATAACAAAAAAAAAAAAACATTTAAACATTAGAAGCCTGTCT
TACAACAGGAAAACAACCCTTATAAGCATAAGACGGACTACGGCCATGCCGGCGTGACCGTAAAAAAAC
TGGTCACCGTGATTAAAAAGCACCACCGACAGTTCCTCGGTCATGTCCGGAGTCATAATGTAAGACTCGG
TAAACACATCAGGTTGGTTAACATCGGTCAGTGCTAAAAAGCGACCGAAATAGCCCGGGGGAATACATAC
CCGCAGGCGTAGAGACAACATTACAGCCCCATAGGAGGTATAACAAAATTAATAGGAGAGAAAACACA
TAAACCCCTGAAAAACCCTCCTGCCCCTAGGCAAAATAGCACCCTCCCGCTCCAGAACAACATACAGCGC
TTCCACAGCGGCAGCCATAACAGTCAGCCTTACCAGTAAAAAACCTATTAAAAAACACCACTCGACACG
GCACCAGCTCAATCAGTCACAGTGTAAAAAGGGCCAAGTACAGAGCGAGTATATATAGGACTAAAAAATG
ACGTAACGGTTAAAGTCCACAAAAACCACCCAGAAAACCGCACGCGAACCTACGCCCAGAAACGAAAGCC
AAAAAACCCACAACTTCCTCAAATCTTCACTTCCGTTTTCCCACGATACGTCACTTCCCATTTTAAAAAA
AAACTACAATTCCCAATACATGCAAGTTACTCCGCCCTAAAACCTACGTCACCCGCCCCGTTCCCACGCC
```

SEQ ID NO:29

CCGCGCCACGTCACAAACTCCACCCCCTCATTATCATATTGGCTTCAATCCAAAATAAGGTATATTATTG
ATGATGGCGAT

FIG. 54 (continued)

SEQ ID NO:30

```
CGCCATCATCAATAATATACCTTATTTTGGATTGAAGCCAATATGATAATGAGGGGGTGGAGTTTGTGAC
GTGGCGCGGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTTACGTGGAGACTCGCCCAGGTGTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGGTAAAGAGGGAGCGGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGTGGTTATTATGA
ATGTGAGGTTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGGTGGTGTGTCGCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC
GCACCAGGTGCAGACCCTGCGAGTGTGGCGGTAAACATATTAGGAACCAGCCTGTGATGCTGGATGTGAC
```

FIG. 55

SEQ ID NO:30 (continued)

```
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGGATATGAG
ATGCATCTTGGACTGTATTTTTAGGTTGGCTATGTTCCCAGCCATATCCCTCCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGGATCATGTCTACCTG
CGGGGCGATGAAGAAAACCGTTTCCGGGGTAGGGAGATCAGCTGGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGCCACTTCGTTAAGCATGTCCCTGACTTGCATGTTTTCCCT
GACCAAATCCGCCAGAAGGCGCTCGCCGCCCAGCGATAGCAGTTCTTGCAAGGAAGCAAAGTTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGCGCCGCACGAGGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCTGGTCAGAAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGACCCCATGGCATGGGTGGGTGAGCGCGGAGGCG
TACATGCCGCAAATGTCGTAAACGTAGAGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
CGCGCAGCTTGTTGACCAGCTCGGCGGTGACCTGCACGTCTAGGGCGCAGTAGTCCAGGGTTTCCTTGAT
```

SEQ ID NO:30 (continued)

```
GATGTCATACTTATCCTGTCCCTTTTTTTTCCACAGCTCGCGGTTGAGGACAAACTCTTCGCGGTCTTTC
CAGTACTCTTGGATCGGAAACCCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAAGTCCGTGCGCTTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCGCGGCGCGACTACGGTACCGCGCGG
CGGGCGGTGGGCCGCGGGGTGTCCTTGGATGATGCATCTAAAAGCGGTGACGCGGGCGGGCCCCCGGAG
GTAGGGGGGGCTCGGGACCCGCCGGGAGAGGGGGCAGGGGCACGTCGGCGCCGCGCGGGCAGGAGCTG
GTGCTGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCAAGGCCTCAAGGCGCTCCATGGCCTCGTAGAAGTCCACGG
CGAAGTTGAAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGGCCTCTTCTTCTTCTTCAATCTCCTCTTCCATA
AGGGCCTCCCCTTCTTCTTCTTCTGGCGGCGGTGGGGGAGGGGGGACACGGCGGCGACGACGGCGCACCG
GGAGGCGGTCGACAAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAAGTGCGGCGGCGG
CTGGCGGTAGAGGGCCAGCGTAGGGTGGCCGGGCTCCGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
TAAATTCGCAAGGGTATCATGGCGGACGACCGGGGTTCGAACCCCGGATCCGGCCGTCCGCCGTGATCCA
```

FIG. 55 (continued)

SEQ ID NO:30 (continued)

```
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGTTTGACCCCGTCACTGGTCTTGTCATGCCTGGGGTATATA
CAAACGAAGCCTTCCATCCAGACATCATTTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCCGGTGGTGGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTTGGCGCGCCCGCCAGCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GGCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
ACACCCAGTGCGCGTGCGCGGGCACTACCGCGCGCCCTGGGGCGCGCACAAACGCGGCCGCACTGGGCGC
```

SEQ ID NO:30 (continued)

```
ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAAGAAGAGATGCTCCAGGTCATCGCGCCGGAGATCTA
TGGCCCCCCGAAGAAGGAAGAGCAGGATTACAAGCCCGAAAGCTAAAGCGGGTCAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCGAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCCGGCGTCCGCGCCGTTCAAGGAAGTACGGCGCCGCCAGCGCGCTACTGCCCGAATATGCCCT
ACATCCTTCCATCGCGCCTACCCCGGCTATCGTGGCTACACCTACCGCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAATAAAAGTCTGGACTCTCACGCTCGCTTGGTCCTGTAACTATTTT
GTAGAATGGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CCGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTTTGGGGTGCAATCCCTGAAGCGCCGACGATGCTTCTGATAGCTAACGTGT
CGTATGTGTGTCATGTATGCGTCCATGTCGCCGCCAGAGGAGCTGCTGAGCCGCCGCGCGCCCGCTTTCC
AAGATGGCTACCCCTTCGATGATGCCGCAGTGGTCTTACATGCACATCTCGGGCCAGGACGCCTCGGAGT
ACCTGAGCCCCGGGCTGGTGCAGTTCGCCCGCGCCACCGAGACGTACTTCAGCCTGAATAACAAGTTTAG
AAACCCCACGGTGGCGCCTACGCACGACGTGACCACAGACCGGTCTCAGCGTTTGACGCTGCGGTTCATC
CCCGTGGACCGCGAGGATACTGCGTACTCGTACAAGGCGCGGTTCACCCTAGCTGTGGGTGATAACCGTG
TGCTAGACATGGCTTCCACGTACTTTGACATCCGCGGCGTGCTGGACAGGGGCCCTACTTTTAAGCCCTA
CTCTGGCACTGCCTACAACGCACTGGCCCCAAGGGTGCCCCAACTCGTGCGAGTGGGAACAAAATGAA
ACTGCACAAGTGGATGCTCAAGAACTTGACGAAGAGGAGAATGAAGCCAATGAAGCTCAGGCGCGAGAAC
AGGAACAAGCTAAGAAACCCATGTATATGCCCAGGCTCCACTGTCCGGAATAAAATAACTAAAGAAGG
TCTACAAATAGGAACTGCCGACGCCACAGTAGCAGGTGCCGGCAAAGAAATTTTCGCAGACAAAACTTTT
CAACCTGAACCACAAGTAGGAGAATCTCAATGGAACGAAGCGGATGCCACAGCAGCTGGTGGAAGGGTTC
TTAAAAAGACAACTCCCATGAAACCCTGCTATGGCTCATACGCTAGACCCACCAATTCCAACGGCGGACA
GGGCGTTATGGTTGAACAAAATGGTAAATTGGAAAGTCAAGTCGAAATGCAATTTTTTTCCACATCCACA
```

SEQ ID NO:30 (continued)

```
AATGCCACAAATGAAGTTAACAATATACAACCAACAGTTGTATTGTACAGCGAAGATGTAAACATGGAAA
CTCCAGATACTCATCTTTCTTATAAACCTAAAATGGGGGATAAAAATGCCAAAGTCATGCTTGGACAACA
AGCAATGCCAAACAGACCAAATTACATTGCTTTTAGAGACAATTTTATTGGTCTCATGTATTACAACAGC
ACAGGTAACATGGGTGTCCTTGCTGGTCAGGCATCGCAGTTGAACGCTGTTGTAGATTTGCAAGACAGAA
ACACAGAGCTGTCCTACCAGCTTTTGCTTGATTCAATTGGCGACAGAACAAGATACTTTTCAATGTGGAA
TCAAGCTGTTGACAGCTATGATCCAGATGTCAGAATTATTGAGAACCATGGAACTGAGGATGAGTTGCCA
AATTATTGCTTTCCTCTTGGTGGAATTGGGATTACTGACACTTTTCAAGCTGTTAAAACAACTGCTGCTA
ACGGGGACCAAGGCAATACTACCTGGCAAAAAGATTCAACATTTGCAGAACGCAATGAAATAGGGGTGGG
AAATAACTTTGCCATGGAAATTAACCTGAATGCCAACCTATGGAGAAATTTCCTTTACTCCAATATTGCG
CTGTACCTGCCAGACAAGCTAAAATACAACCCCACCAATGTGGAAATATCTGACAACCCCAACACCTACG
ACTACATGAACAAGCGAGTGGTGGCTCCTGGGCTTGTAGACTGCTACATTAACCTTGGGCGCGCTGGTC
TCTGGACTACATGGACAACGTTAATCCCTTTAACCACCCCGCCATGCGGGCCTGCGTTACCGCTCCATG
TTGTTGGGAAACGGCCGCTACGTGCCCTTTCACATTCAGGTGCCCCAAAAGTTTTTTGCCATTAAAAACC
TCCTCCTCCTGCCAGGCTCATACACATATGAATGGAACTTCAGGAAGGATGTTAACATGGTTCTGCAGAG
CTCTCTGGGAAACGACCTTAGAGTTGACGGGGCTAGCATTAAGTTTGACAGCATTTGTCTTTACGCCACC
TTCTTCCCCATGGCCCACAACACGGCCTCCACGCTGGAAGCCATGCTCAGAAATGACACCAACGACCAGT
CCTTTAATGACTACCTTTCCGCCGCCAACATGCTATATCCCATACCCGCCAACGCCACCAACGTGCCCAT
CTCCATCCCATCGCGCAACTGGGCAGCATTTCGCGGTTGGGCCTTCACACGCTTGAAGACAAAGGAAACC
CCTTCCCTGGGATCAGGCTACGACCCTTACTACACCTACTCTGGCTCCATACCATACCTTGACGGAACCT
TCTATCTTAATCACACCTTTAAGAAGGTGGCCATTACTTTTGACTCTTCTGTTAGCTGGCCGGGCAACGA
CCGCCTGCTTACTCCCAATGAGTTTGAGATTAAGCGCTCAGTTGACGGGGAGGGCTATAACGTAGCTCAG
TGCAACATGACAAAGGACTGGTTCCTAGTGCAGATGTTGGCCAACTACAATATTGGCTACCAGGGCTTCT
ACATTCCAGAAAGCTACAAAGACCGCATGTACTCGTTCTTCAGAAACTTCCAGCCCATGAGCCGGCAAGT
GGTGGACGATACTAAATACAAAGATTATCAGCAGGTTGGAATTATCCACCAGCATAACAACTCAGGCTTC
GTAGGCTACCTCGCTCCCACCATGCGCGAGGGACAAGCTTACCCCGCTAATGTTCCCTACCCACTAATAG
GCAAAACCGCGGTTGATAGTATTACCCAGAAAAAGTTTCTTTGCGACCGCACCCTGTGGCGCATCCCCTT
CTCCAGTAACTTTATGTCCATGGGTGCGCTCACAGACCTGGGCCAAAACCTTCTCTACGCAAACTCCGCC
CACGCGCTAGACATGACCTTTGAGGTGGATCCCATGGACGAGCCCACCCTTCTTTATGTTTTGTTTGAAG
TCTTTGACGTGGTCCGTGTGCACCAGCCGCACCGCGGCGTCATCGAGACCGTGTACCTGCGCACGCCCTT
CTCGGCCGGCAACGCCACAACATAAAGAAGCAAGCAACATCAACAACAGCTGCCGCCATGGGCTCCAGTG
AGCAGGAACTGAAAGCCATTGTCAAAGATCTTGGTTGTGGGCCATATTTTTTGGGCACCTATGACAAGCG
CTTCCCAGGCTTTGTTTCCCCACACAAGCTCGCCTGCGCCATAGTTAACACGGCCGGTCGCGAGACTGGG
GGCGTACACTGGATGGCCTTTGCCTGGAACCCGCGCTCAAAAACATGCTACCTCTTTGAGCCCTTTGGCT
TTTCTGACCAACGTCTCAAGCAGGTTTACCAGTTTGAGTACGAGTCACTCCTGCGCCGTAGCGCCATTGC
CTCTTCCCCCGACCGCTGTATAACGCTGGAAAAGTCCACCCAAAGCGTGCAGGGGCCCAACTCGGCCGCC
TGTGGCCTATTCTGCTGCATGTTTCTCCACGCCTTTGCCAACTGGCCCCAAACTCCCATGGATCACAACC
CCACCATGAACCTTATTACCGGGGTACCCAACTCCATGCTTAACAGTCCCCAGGTACAGCCCACCCTGCG
CCGCAACCAGGAACAGCTCTACAGCTTCCTGGAGCGCCACTCGCCCTACTTCCGCAGCCACAGTGCGCAA
ATTAGGAGCGCCACTTCTTTTTGTCACTTGAAAAACATGTAAAAATAATGTACTAGGAGACACTTTCAAT
AAAGGCAAATGTTTTTATTTGTACACTCTCGGGTGATTATTTACCCCCACCCTTGCCGTCTGCGCCGTTT
AAAAATCAAAGGGGTTCTGCCGCGCATCGCTATGCGCCACTGGCAGGGACACGTTGCGATACTGGTGTTT
AGTGCTCCACTTAAACTCAGGCACAACCATCCGCGGCAGCTCGGTGAAGTTTTCACTCCACAGGCTGCGC
ACCATCACCAACGCGTTTAGCAGGTCGGGCGCCGATATCTTGAAGTCGCAGTTGGGGCCTCCGCCCTGCG
CGCGCGAGTTGCGATACACAGGGTTACAGCACTGGAACACTATCAGCGCCGGGTGGTGCACGCTGGCCAG
CACGCTCTTGTCGGAGATCANATCCGCGTCCAGGTCCTCCGCGTTGCTCAGGGCGAACGGAGTCAACTTT
GGTAGCTGCCTTCCCAAAAAGGGTGCATGCCCAGGCTTTGAGTTGCACTCGCACCGTAGTGGCATCAGAA
GGTGACCGTGCCCAGTCTGGGCGTTAGGATACAGCGCCTGCATGAAAGCCTTGATCTGCTTAAAAGCCAC
CTGAGCCTTTGCGCCTTCAGAGAAGAACATGCCGCAAGACTTGCCGGAAAACTGATTGGCCGGACAGGCC
GCGTCATGCACGCAGCACCTTGCGTCGGTGTTGGAGATCTGCACCACATTTCGGCCCCACCGGTTCTTCA
CGATCTTGGCCTTGCTAGACTGCTCCTTCAGCGCGCGCTGCCCGTTTTCGCTCGTCACATCCATTTCAAT
CACGTGCTCCTTATTTATCATAATGCTCCCGTGTAGACACTTAAGCTCGCCTTCGATCTCAGCGCAGCGG
TGCAGCCACAACGCGCAGCCCGTGGGCTCGTGGTGCTTGTAGGTTACCTCTGCAAACGACTGCAGGTACG
```

SEQ ID NO:30 (continued)

```
CCTGCAGGAATCGCCCCATCATCGTCACAAAGGTCTTGTTGCTGGTGAAGGTCAGCTGCAACCCGCGGTG
CTCCTCGTTTAGCCAGGTCTTGCATACGGCCGCCAGAGCTTCCACTTGGTCAGGCAGTAGCTTGAAGTTT
GCCTTTAGATCGTTATCCACGTGGTACTTGTCCATCAACGCGCGCGCAGCCTCCATGCCCTTCTCCCACG
CAGACACGATCGGCAGGCTCAGCGGGTTTATCACCGTGCTTTCACTTTCCGCTTCACTGGACTCTTCCTT
TTCCTCTTGCATCCGCATACCCCGCGCCACTGGGTCGTCTTCATTCAGCCGCCGCACCGTGCGCTTACCT
CCCTTGCCGTGCTTGATTAGCACCGGTGGGTTGCTGAAACCCACCATTTGTAGCGCCACATCTTCTCTTT
CTTCCTCGCTGTCCACGATCACCTCTGGGGATGGCGGGCGCTCGGGCTTGGGAGAGGGGCGCTTCTTTTT
CTTTTTGGACGCAATGGCCAAATCCGCCGTCGAGGTCGATGGCCGCGGGCTGGGTGTGCGCGGCACCAGC
GCATCTTGTGACGAGTCTTCTTCGTCCTCGGACTCGAGACGCCGCCTCAGCCGCTTTTTGGGGCGCGC
GGGGAGGCGGCGGCGACGGCGACGGGGACGAGACGTCCTCCATGGTTGGTGGACGTCGCGCCGCACCGCG
TCCGCGCTCGGGGGTGGTTTCGCGCTGCTCCTCTTCCCGACTGGCCATTTCCTTCTCCTATAGGCAGAAA
AAGATCATGGAGTCAGTCGAGAAGGAGGACAGCCTAACCGCCCCCTTTGAGTTCGCCACCACCGCCTCCA
CCGATGCCGCCAACGCGCCTACCACCTTCCCCGTCGAGGCACCCCGCTTGAGGAGGAGGAAGTGATTAT
CGAGCAGGACCCAGGTTTTGTAAGCGAAGACGACGAAGATCGCTCAGTACCAACAGAGGATAAAAAGCAA
GACCAGGACGACGCAGAGGCAAACGAGGAACAAGTCGGGCGGGGGACCAAAGGCATGGCGACTACCTAG
ATGTGGGAGACGACGTGCTGTTGAAGCATCTGCAGCGCCAGTGCGCCATTATCTGCGACGCGTTGCAAGA
GCGCAGCGATGTGCCCCTCGCCATAGCGGATGTCAGCCTTGCCTACGAACGCCACCTGTTCTCACCGCGC
GTACCCCCAAACGCCAAGAAAACGGCACATGCGAGCCCAACCCGCGCCTCAACTTCTACCCCGTATTTG
CCGTGCCAGAGGTGCTTGCCACCTATCACATCTTTTTCCAAAACTGCAAGATACCCCTATCCTGCCGTGC
CAACCGCAGCCGAGCGGACAAGCAGCTGGCCTTGCGGCAGGGCGCTGTCATACCTGATATCGCCTCGCTC
GACGAAGTGCCAAAAATCTTTGAGGGTCTTGGACGCGACGAGAAGCGCGCGGCAAACGCTCTGCAACAAG
AAAACAGCGAAAATGAAAGTCACTGTGGAGTGCTGGTGGAACTTGAGGGTGACAACGCGCGCCTAGCCGT
GCTGAAACGCAGCATCGAGGTCACCCACTTTGCCTACCCGGCACTTAACCTACCCCCAAGGTTATGAGC
ACAGTCATGAGCGAGCTGATCGTGCGCCGTGCACGACCCTGGAGAGGGATGCAAACTTGCAAGAACAAA
CCGAGGAGGGCCTACCCGCAGTTGGCGATGAGCAGCTGGCGCGCTGGCTTGAGACGCGCGAGCCTGCCGA
CTTGGAGGAGCGACGCAAGCTAATGATGGCCGCAGTGCTTGTTACCGTGGAGCTTGAGTGCATGCAGCGG
TTCTTTGCTGACCCGGAGATGCAGCGCAAGCTAGAGGAAACGTTGCACTACACCTTTCGCCAGGGCTACG
TGCGCCAGGCCTGCAAAATTTCCAACGTGGAGCTCTGCAACCTGGTCTCCTACCTTGGAATTTTGCACGA
AAACCGCCTTGGGCAAAACGTGCTTCATTCCACGCTCAAGGGCGAGGCGCGCCGCGACTACGTCCGCGAC
TGCGTTTACTTATTTCTGTGCTACACCTGGCAAACGGCCATGGGCGTGTGGCAGCAGTGCCTGGAGGAGC
GCAACCTGAAGGAGCTGCAGAAGCTGCTAAAGCAAAACTTGAAGGACCTATGGACGGCCTTCAACGAGCG
CTCCGTGGCCGCGCACCTGGCGGACATTATCTTCCCCGAACGCCTGCTTAAAACCCTGCAACAGGGTCTG
CCAGACTTCACCAGTCAAAGCATGTTGCAAAACTTTAGGAACTTTATCCTAGAGCGTTCAGGAATTCTGC
CCGCCACCTGCTGTGCGCTTCCTAGCGACTTTGTGCCCATTAAGTACCGTGAATGCCCTCCGCCGCTTTG
GGGTCACTGCTACCTTNTGCAGCTAGCCAACTACCTTGCCTACCACTCCGACATCATGGAAGACGTGAGC
GGTGACGGCCTACTGGAGTGTCACTGTCGCTGCAACCTATGCACCCCGCACCGCTCCTGGTCTGCAATT
CACAACTGCTTAGCGAAAGTCAAATTATCGGTACCTTTGAGCTGCAGGGTCCCTCGCCTGACGAAAAGTC
CGCGGCTCCGGGGTTGAAACTCACTCCGGGGCTGTGGACGTCGGCTTACCTTCGCAAATTTGTACCTGAG
GACTACCACGCCCACGAGATTAGGTTCTACGAAGACCAATCCCGCCCGCCAAATGCGGAGCTTACCGCCT
GCGTCATTACCCAGGGCACATCCTTGGCCAATTGCAAGCCATTAACAAAGCCCGCCAAGAGTTTCTGCT
ACGAAAGGGACGGGGGGTTTACTTGGACCCCCAGTCCGGCGAGGAGCTCAACCCAATCCCCCGCCGCCG
CAGCCCTATCAGCAGCCGCGGGCCCTTGCTTCCCAGGATGGCACCCAAAAAGAAGCTGCAGCTGCCGCCG
CCGCCACCCACGGACGAGGAGGAATACTGGGACAGTCAGGCAGAGGAGGTTTTGGACGAGGAGGAGGAGA
TGATGGAAGACTGGGACAGCCTAGACGAGGAAGCTTCCGAGGCCGAAGAGGTGTCAGACGAAACACCGTC
ACCCTCGGTCGCATTCCCTCGCCGGCGCCCCAGAAATCGGCAACCGTTCCCAGCATTGCTACAACCTCC
GCTCCTCAGGCGCCGCCGGCACTGCCCGTTCGCCGACCCAACCGTAGATGGGACACCACTGGAACCAGGG
CCGGTAAGTCTAAGCAGCCGCCGCCGTTAGCCCAAGAGCAACAACAGCGCCAAGGCTACCGCTCGTGGCG
CGTGCACAAGAACGCCATAGTTGCTTGCTTGCAAGACTGTGGGGCAACATCTCCTTCGCCCGCCGCTTT
CTTCTCTACCATCACGGCGTGGCCTTCCCCGTAACATCCTGCATTACTACCGTCATCTCTACAGCCCCT
ACTGCACCGGCGGCAGCGGCAGCAACAGCAGCGGCCACGCAGAAGCAAAGGCGACCGGATAGCAAGACTC
TGACAAAGCCCAAGAAATCCACAGCGGCGGCAGCAGCAGGAGGAGGAGCACTGCGTCTGGCGCCCAACGA
ACCCGTATCGACCCGCGAGCTTAGAAACAGGATTTTTCCCACTCTGTATGCTATATTTCAACAGAGCAGG
```

SEQ ID NO:30 (continued)

```
GGCCAAGAACAAGAGCTGAAAATAAAAAACAGGTCTCTGCGCTCCCTCACCCGCAGCTGCCTGTATCACA
AAAGCGAAGATCAGCTTCGGCGCACGCTGGAAGACGCGGAGGCTCTCTTCAGCAAATACTGCGCGCTGAC
TCTTAAGGACTAGTTTCGCGCCCTTTCTCAAATTTAAGCGCGAAAACTACGTCATCTCCAGCGGCCACAC
CCGGCGCCAGCACCTGTCGTCAGCGCCATTATGAGCAAGGAAATTCCCACGCCCTACATGTGGAGTTACC
AGCCACAAATGGGACTTGCGGCTGGAGCTGCCCAAGACTACTCAACCCGAATAAACTACATGAGCGCGGG
ACCCCACATGATATCCCGGGTCAACGGAATCCGCGCCCACCGAAACCGAATTCTCCTCGAACAGGCGGCT
ATTACCACCACACCTCGTAATAACCTTAATCCCCGTAGTTGGCCCGCTGCCCTGGTGTACCAGGAAAGTC
CCGCTCCCACCACTGTGGTACTTCCCAGAGACGCCCAGGCCGAAGTTCAGATGACTAACTCAGGGGCGCA
GCTTGCGGGCGGCTTTCGTCACAGGGTGCGGTCGCCCGGGCAGGGTATAACTCACCTGAAAATCAGAGGG
CGAGGTATTCAGCTCAACGACGAGTCGGTGAGCTCCTCTCTTGGTCTCCGTCCGGACGGGACATTTCAGA
TCGGCGGCGCGTGGCCGCTCTTCATTTACGCCCCGTCAGGCGATCCTAACTCTGCAGACCTCGTCCTCGG
AGCCGCGCTCCGGAGGCATTGGAACTCTACAATTTATTGAGGAGTTCGTGCCTTCGGTTTACTTCAACCC
CTTTTCTGGACCTCCCGGCCACTACCCGGACCAGTTTATTCCCAACTTTGACGCGGTAAAAGACTCGGCG
GACGGCTACGACTGAATGACCAGTGGAGAGGCAGAGCAACTGCGCCTGACACACCTCGACCACTGCCGCC
GCCACAAGTGCTTTGCCCGCGGCTCCGGTGAGTTTTGTTACTTTGAATTGCCCGAAGAGCATATCGAGGG
CCCGGCGCACGGCGTCCGGCTCACCACCCAGGTAGGGATAACAGGGTAATTGAGACATGATTCCTCGAGT
CCTTATATTATTGACCCTTGTTGCGCTTTTCTGTGCGTGCTCTACATTGGCTGCGGTCGCTCACATCGAA
GTAGATTGCATCCCACCTTTCACAGTTTACCTGCTTTACGGATTTGTCACCCTTATCCTCATCTGCAGCC
TCGTCACTGTAGTCATCGCCTTCATTCAGTTCATTGACTGGATTTGTGTGCGCATTGCGTACCTTAGGCA
CCATCCGCAATACAGAGACAGGACTATAGCTGATCTTCTCAGAATTCTTTAATTATGAAACGGATTGTCA
CTTTTGTTTTGCTGATTTTCTGCGCCCTACCTGTGCTTTGCTCCCAAACCTCAGCGCCTCCCAAAAGACA
TATTTCCTGCAGATTCACTCAAATATGGAACATTCCCAGCTGCTACAACAAACAGAGCGATTTGTCAGAA
GCCTGGTTATACGCCATCATCTCTGTCATGGTTTTTTGCAGTACCATTTTTGCCCTAGCCATATACCCAT
ACCTTGACATTGGTTGGAATGCCATAGATGCCATGAACCACCCTACTTTCCAGCGCCCAATGTCATACC
ACTGCAACAGGTTATTGCCCCAATCAATCAGCCTCGCCCCCTTCTCCCACCCCACTGAGATTAGCTAC
TTTAATTTGACAGGTGGAGATGACTGAATCTCTAGATCTAGAATTGGATGGAATTAACACCGAACAGCGC
CTACTAGAAAGGCGCAAGGCGGCGTCCGAGCGAGAACGCCTAAAACAAGAAGTTGAAGACATGGTTAACC
TGCACCAGTGTAAAAGAGGTATCTTTTGTGTGGTCAAGCAGGCCAAACTTACCTACGAAAAACCACTAC
CGGCAACCGCCTTAGCTACAAGCTACCCACCCAGCGCCAAAAACTGGTGCTTATGGTGGGAGAAAAACCT
ATCACCGTCACCCAGCACTCGGCAGAAACAGAAGGCTGCCTGCACTTCCCTATCAGGGTCCAGAGGACC
TCTGCACTCTTATTAAAACCATGTGTGGCATTAGAGATCTTATTCCATTCAACTAACAATAAACACACAA
TAAATTACTTACTTAAAATCAGTCAGCAAATCTTTGTCCAGCTTATTCAGCATCACCTCCTTTCCCTCCT
CCCAACTCTGGTATTTCAGCAGCCTTTTAGCTGCGAACTTTCTCCAAAGTCTAAATGGGATGTCAAATTC
CTCATGTTCTTGTCCCTCCGCACCCACTATCTTCATATTGTTGCAGATGAAACGCGCCAGACCGTCTGAA
GACACCTTCAACCCTGTGTACCCATATGACACGGAAACCGGCCCTCCAACTGTGCCTTTCCTTACCCCTC
CCTTTGTGTCGCCAAATGGGTTCCAAGAAAGTCCCCCGGAGTGCTTTCTTTGCGTCTTTCAGAACCTTT
GGTTACCTCACACGGCATGCTTGCGCTAAAAATGGGCAGCGGCCTGTCCCTGGATCAGGCAGGCAACCTT
ACATCAAATACAATCACTGTTTCTCAACCGCTAAAAAAACAAAGTCCAATATAACTTTGGAAACATCCG
CGCCCCTTACAGTCAGCTCAGGCGCCCTAACCATGGCCACAACTTCGCCTTTGGTGGTCTCTGACAACAC
TCTTACCATGCAATCACAAGCACCGCTAACCGTGCAAGACTCAAAACTTAGCATTGCTACCAAAGAGCCA
CTTACAGTGTTAGATGGAAAACTGGCCCTGCAGACATCAGCCCCCTCTCTGCCACTGATAACAACGCCC
TCACTATCACTGCCTCACCTCCTCTTACTACTGCAAATGGTAGTCTGGCTGTTACCATGGAAAACCCACT
TTACAACAACAATGGAAAACTTGGGCTCAAAATTGGCGGTCCTTTGCAAGTGGCCACCGACTCACATGCA
CTAACACTAGGTACTGGTCAGGGGGTTGCAGTTCATAACAATTTGCTACATACAAAAGTTACAGGCGCAA
TAGGGTTTGATACATCTGGCAACATGGAACTTAAAACTGGAGATGGCCTCTATGTGGATAGCGCCGGTCC
TAACCAAAAACTACATATTAATCTAAATACCACAAAAGGCCTTGCTTTTGACAACACCGCAATAACAATT
AACGCTGGAAAAGGGTTGGAATTTGAAACAGACTCCTCAAACGGAAATCCCATAAAAACAAAAATTGGAT
CAGGCATACAATATAATACCAATGGAGCTATGGTTGCAAAACTTGGAACAGGCCTCAGTTTTGACAGCTC
CGGAGCCATAACAATGGGCAGCATAAACAATGACAGACTTACTCTTTGGACAACACCAGACCCATCCCCA
AATTGCAGAATTGCTTCAGATAAAGACTGCAAGCTAACTCTGGCGCTAACAAAATGTGGCAGTCAAATTT
TGGGCACTGTTTCAGCTTTGGCAGTATCAGGTAATATGGCCTCCATCAATGGAACTCTAAGCAGTGTAAA
CTTGGTTCTTAGATTTGATGACAACGGAGTGCTTATGTCAAATTCATCACTGGACAAACAGTATTGGAAC
```

SEQ ID NO:30 (continued)

```
TTTAGAAACGGGGACTCCACTAACGGTCAACCATACACTTATGCTGTTGGGTTTATGCCAAACCTAAAAG
CTTACCCAAAAACTCAAAGTAAAACTGCAAAAAGTAATATTGTTAGCCAGGTGTATCTTAATGGTGACAA
GTCTAAACCATTGCATTTTACTATTACGCTAAATGGAACAGATGAAACCAACCAAGTAAGCAAATACTCA
ATATCATTCAGTTGGTCCTGGAACAGTGGACAATACACTAATGACAAATTTGCCACCAATTCCTATACCT
TCTCCTACATTGCCCAGGAATAAAGAATCGTGAACCTGTTGCATGTTATGTTTCAACGTGTTTATTTTTC
AATTCGTATTAGTCATCGCTATTACCATGGTGATGCGGTTTTGGCAGTACATCAATGGGCGTGGATAGCG
GTTTGACTCACGGGGATTTCCAAGTCTCCACCCCATTGACGTCAATGGGAGTTTGTTTTGGCACCAAAAT
CAACGGGACTTTCCAAAATGTCGTAACAACTCCGCCCCATTGACGCAAATGGGCGGTAGGCGTGTACGGT
GGGAGGTCTATATAAGCAGAGCTGGTTTAGTGAACCGTCAGATCCGCTAGAGATCCACCATGTTTGTCTT
TCTCGTGCTGCTGCCCCTCGTGAGCAGCCAGTGCGTCAATCTGACAACAAGGACCCAGCTGCCCCCCGCC
TACACCAACTCCTTCACAAGAGGCGTGTATTACCCCGATAAGGTCTTCAGATCCAGCGTCCTCCACAGCA
CCCAAGATTTGTTTCTGCCTTTCTTCAGCAACGTGACATGGTTCCACGCCATTCATGTCAGCGGCACAAA
CGGCACAAGAGGTTTGACAACCCCGTGCTCCCCTTCAACGACGGCGTGTACTTCGCCAGCACAGAGAAA
TCCAATATCATTAGGGGCTGGATCTTCGGCACAACACTGGATTCCAAGACCCAGTCTCTGCTCATTGTGA
ATAACGCCACCAACGTGGTGATTAAGGTCTGTGAGTTTCAGTTCTGCAACGACCCCTTTCTGGGAGTCTA
CTACCACAAGAATAATAAGAGCTGGATGGAGTCCGAGTTTAGGGTGTACAGCTCCGCCAACAACTGTACC
TTCGAATACGTGTCCCAGCCTTTCCTCATGGATCTGGAGGGCAAGCAAGGCAATTTCAAAAATCTGAGAG
AGTTCGTGTTCAAAAACATTGATGGATACTTCAAAATCTACAGCAAGCATACCCCCATTAATCTGGTGAG
GGATCTGCCCCAAGGATTCTCCGCTCTGGAACCTCTGGTGGATCTGCCCATTGGCATTAACATCACAAGA
TTCCAGACCCTCCTCGCCCTCCATAGATCCTATCTGACCCCCGGCGACTCCTCCAGCGGATGGACAGCCG
GAGCTGCCGCCTACTACGTGGGCTATCTGCAGCCAAGAACCTTTCTGCTGAAGTACAACGAGAACGGCAC
CATCACAGACGCTGTCGATTGCGCTCTCGACCCTCTGAGCGAGACCAAATGCACACTGAAGAGCTTCACC
GTGGAAAAGGGCATCTATCAGACCAGCAACTTCAGAGTGCAGCCTACCGAGAGCATTGTGAGGTTTCCCA
ACATCACCAATCTGTGTCCTTTCGGCGAGGTCTTTAATGCCACAAGGTTCGCTTCCGTGTATGCTTGGAA
TAGGAAGAGGATCAGCAATTGCGTCGCCGACTATTCCGTCCTCTATAACAGCGCCTCCTTCTCCACCTTC
AAATGTTATGGCGTGTCCCCCACCAAGCTCAACGACCTCTGCTTCACCAATGTGTACGCTGACTCCTTCG
TCATTAGGGGCGACGAGGTGAGGCAAATTGCCCCCGGCCAGACCGGCAAGATTGCTGATTACAACTACAA
ACTGCCCGACGATTTTACCGGCTGCGTGATCGCTTGGAACTCCAACAATCTGGACTCCAAAGTGGGCGGA
AACTACAATTACCTCTACAGACTCTTTAGAAAAAGCAATCTGAAGCCCTTCGAGAGAGACATCTCCACCG
AAATCTACCAAGCCGGAAGCACACCTTGCAATGGCGTCGAGGGATTTAACTGCTACTTCCCTCTGCAGAG
CTACGGCTTTCAACCTACCAACGGCGTCGGATATCAACCCTATAGGGTGGTCGTGCTGAGCTTTGAACTG
CTGCATGCTCCCGCCACCGTCTGCGGACCTAAGAAGAGCACCAATCTCGTCAAAAACAAGTGCGTGAACT
TCAACTTCAATGGACTGACCGGCACCGGCGTGCTGACCGAGAGCAATAAGAAGTTTCTGCCCTTCCAGCA
GTTCGGAAGGGATATTGCCGATACCACAGATGCTGTGAGGGACCCCCAAACCCTCGAGATTCTGGATATC
ACCCCTTGCAGCTTCGGAGGAGTGTCCGTGATCACCCCCGGAACAAACACCTCCAATCAAGTGGCTGTGC
TGTACCAAGACGTGAACTGCACAGAAGTCCCCGTGGCCATCCATGCCGACCAGCTGACCCCTACATGGAG
AGTGTACTCCACCGGCAGCAATGTGTTCCAGACAAGAGCCGGATGCCTCATTGGAGCTGAACACGTCAAC
AACAGCTACGAGTGCGACATTCCCATCGGCGCCGGCATTTGTGCCTCCTATCAGACCCAGACCAACAGCC
CAAGAAGGGCTAGAAGCGTCGCTTCCCAATCCATCATTGCCTACACCATGTCTCTGGGAGCCGAAAACTC
CGTCGCCTACTCCAACAATAGCATCGCCATCCCCACCAATTTTACCATCTCCGTGACCACAGAGATTCTG
CCCGTGTCCATGACAAAGACATCCGTGGACTGCACCATGTACATCTGTGGCGACAGCACCGAGTGTAGCA
ATCTGCTGCTGCAATATGGCAGCTTCTGCACCCAGCTGAACAGAGCCCTCACCGGCATCGCCGTCGAACA
AGACAAGAACACCCAAGAGGTGTTCGCCCAAGTGAAGCAAATCTACAAGACCCCCCCTATCAAAGATTTC
GGAGGATTCAACTTTAGCCAGATTCTGCCCGATCCTAGCAAGCCTTCCAAGAGGAGCTTCATCGAGGATC
TGCTGTTTAATAAGGTGACACTGGCCGACGCTGGCTTCATTAAACAGTACGGCGATTGTCTGGGCGACAT
CGCTGCTAGGGATCTGATCTGCGCTCAGAAGTTCAACGGACTGACAGTCCTCCCTCCTCTGCTGACCGAC
GAGATGATCGCTCAGTATACCAGCGCTCTGCTGGCTGGAACCATTACCAGCGGCTGGACATTCGGCGCTG
GAGCCGCCCTCCAAATTCCCTTTGCCATGCAGATGGCCTATAGATTCAACGGCATTGGCGTCACCCAAAA
TGTGCTGTATGAAAATCAGAAGCTGATTGCTAACCAATTCAATAGCGCCATTGGCAAGATCCAAGACTCT
CTGAGCTCCACAGCCAGCGCCCTCGGAAAGCTGCAAGACGTGGTGAATCAAAACGCCCAAGCTCTGAACA
CACTGGTGAAACAGCTCAGCAGCAACTTTGGAGCCATCAGCAGCGTGCTCAATGATATCCTCTCTAGGCT
GGACAAAGTGGAGGCCGAAGTCCAGATCGATAGACTCATCACCGGCAGACTCCAATCTCTGCAGACATAC
```

SEQ ID NO:30 (continued)

```
GTCACCCAACAGCTCATTAGAGCTGCCGAAATCAGAGCCTCCGCCAATCTGGCCGCCACCAAGATGTCCG
AGTGCGTGCTGGGACAGAGCAAGAGAGTGGACTTCTGTGGCAAGGGATACCATCTGATGAGCTTCCCCCA
GAGCGCTCCCCATGGAGTGGTCTTTCTGCATGTCACATACGTGCCCGCCCAAGAGAAGAACTTCACCACC
GCTCCCGCCATTTGCCACGATGGAAAGGCCCACTTTCCCAGAGAAGGAGTGTTCGTGAGCAACGGCACAC
ACTGGTTTGTCACCCAGAGAAATTTTTACGAGCCCCAGATTATCACCACCGACAACACCTTCGTGTCCGG
AAACTGCGATGTCGTGATTGGCATCGTGAACAACACAGTCTACGACCCTCTGCAGCCCGAACTCGACAGC
TTCAAGGAAGAGCTGGACAAGTACTTCAAGAATCACACATCCCCCGACGTGGATCTGGGCGACATTAGCG
GCATTAATGCCTCCGTCGTCAACATTCAGAAGGAGATTGATAGACTGAATGAAGTCGCCAAGAACCTCAA
TGAGTCTCTGATTGATCTGCAAGAGCTGGGCAAGTACGAGCAATACATCAAATGGCCTTGGTACATCTGG
CTGGGATTCATCGCTGGACTCATCGCCATCGTGATGGTCACCATTATGCTGTGTTGCATGACCAGCTGCT
GCAGCTGTCTGAAGGGCTGCTGCAGCTGCGGAAGCTGCTGCAAGTTTGACGAAGACGACTCCGAGCCCGT
GCTGAAGGGCGTCAAGCTGCATTATACATAAACTAGTGCTGGAATTCGCCCTTATAGAGTGCTGGAATTC
GCCCTTATAGAGTGCTGGAATTCGCCCTTATATCTAGTAACGGCCGCCAGTGTGCTGGAATTCGCCCTTA
TAACTTCGTATAGCATACATTATACGAAGTTATAAGGGCGAATTCTGCAGATATCCATCCTTTAAAAAAC
CTCCCACACCTCCCCCTGAACCTGAAACATAAAATGAATGCAATTGTTGTTGTTAACTTGTTTATTGCAG
CTTATAATGGTTACAAATAAAGCAATAGCATCACAAATTTCACAAATAAAGCATTTTTTTCACTGCATTC
TAGTTGTGGTTTGTCCAAACTCATCAATGTATCTTAACAACGTGTTTATTTTTCAATTGCAGAAAGAATT
GCAGAAAATTTCAAGTCATTTTTCATTCAGTAGTATAGCCCCACCACCACATAGCTTATACTAATCACCG
TACCTTAATCAAACTCACAGAACCCTAGTATTCAACCTGCCACCTCCCTCCCAACACACAGAGTACACAG
TCCTTTCTCCCCGGCTGGCCTTAAACAGCATCATATCATGGGTAACAGACATATTCTTAGGTGTTATATT
CCACACGGTCTCCTGTCGAGCCAAACGCTCATCAGTGATGTTAATAAACTCCCCGGGCAGCTCGCTTAAG
TTCATGTCGCTGTCCAGCTGCTGAGCCACAGGCTGCTGTCCAACTTGCGGTTGCTCAACGGGCGGCGAAG
GAGAAGTCCACGCCTACATGGGGGTAGAGTCATAATCGTGCATCAGGATAGGGCGGTGGTGCTGCAGCAG
CGCGCGAATAAACTGCTGCCGCCGCCGCTCCGTCCTGCAGGAATACAACATGGCAGTGGTCTCCTCAGCG
ATGATTCGCACCGCCCGCAGCATAAGGCGCCTTGTCCTCCGGGCACAGCAGCGCACCCTGATCTCACTTA
AGTCAGCACAGTAACTGCAGCACAGTACCACAATATTGTTTAAAATCCCACAGTGCAAGGCGCTGTATCC
AAAGCTCATGGCGGGGACCACAGAACCCACGTGGCCATCATACCACAAGCGCAGGTAGATTAAGTGGCGA
CCCCTCATAAACACGCTGGACATAAACATTACCTCTTTTGGCATGTTGTAATTCACCACCTCCCGGTACC
ATATAAACCTCTGATTAAACATGGCGCCATCCACCACCATCCTAAACCAGCTGGCCAAAACCTGCCCGCC
GGCTATGCACTGCAGGGAACCGGGACTGGAACAATGACAGTGGAGAGCCCAGGACTCGTAACCATGGATC
ATCATGCTCGTCATGATATCAATGTTGGCACAACACAGGCACACGTGCATACACTTCCTCAGGATTACAA
GCTCCTCCCGCGTCAGAACCATATCCCAGGGAACAACCCATTCCTGAATCAGCGTAAATCCCACACTGCA
GGGAAGACCTCGCACGTAACTCACGTTGTGCATTGTCAAAGTGTTACATTCGGGCAGCAGCGGATGATCC
TCCAGTATGGTAGCGCGTGTCTCTGTCTCAAAAGGAGGTAGGCGATCCCTACTGTACGGAGTGCGCCGAG
ACAACCGAGATCGTGTTGGTCGTAGTGTCATGCCAAATGGAACGCCGGACGTAGTCATATTTCCTGAAGC
AAAACCAGGTGCGGGCGTGACAAACAGATCTGCGTCTCCGGTCTCGTCGCTTAGCTCGCTCTGTGTAGTA
GTTGTAGTATATCCACTCTCTCAAAGCATCCAGGCGCCCCTGGCTTCGGGTTCTATGTAAACTCCTTCA
TGCGCCGCTGCCCTGATAACATCCACCACCGCAGAATAAGCCACACCCAGCCAACCTACACATTCGTTCT
GCGAGTCACACACGGGAGGAGCGGGAAGAGCTGGAAGAACCATGTTTTTTTTTTTATTCCAAAAGATTA
TCCAAAACCTCAAAATGAAGATCTATTAAGTGAACGCGCTCCCCTCCGGTGGCGTGGTCAAACTCTACAG
CCAAAGAACAGATAATGGCATTTGTAAGATGTTGCACAATGGCTTCCAAAAGGCAAACTGCCCTCACGTC
CAAGTGGACGTAAAGGCTAAACCCTTCANGGTGAATCTCCTCTATAAACATTCCAGCACCTTCAACCATG
CCCAAATAATTTTCATCTCGCCACCTTATCAATATGTCTCTAAGCAAATCCCGAATATTAAGTCCGGCCA
TTGTAAAAATCTGCTCCAGAGCGCCCTCCACCTTCAGCCTCAAGCAGCGAATCATGATTGCAAAAATTCA
GGTTCCTCACAGACCTGTATAAGATTCAAAAGCGGAACATTAACAAAAATACCGCGATCCCGTAGGTCCC
TTCGCAGGGCCAGCTGAACATAATCGTGCAGGTCTGCACGGACCAGCGCGGCCACTTCCCCGCCAGGAAC
CATGACAAAAGAACCCACACTGATTATGACACGCATACTCGGAGCTATGCTAACCAGCGTAGCCCCGATG
TAAGCTTGTTGCATGGGCGGCGATATAAAATGCAAGGTACTGCTCAAAAAATCAGGCAAAGCCTCGCGCA
AAAAAGCAAGCACATCGTAGTCATGCTCATGCAGATAAAGGCAGGTAAGTTCCGGAACCACCACAGAAAA
AGACACCATTTTTCTCTCAAACATGTCTGCGGGTTCCTGCATAAACACAAAATAAAATAACAAAAAAAAA
AAAACATTTAAACATTAGAAGCCTGTCTTACAACAGGAAAAACAACCCTTATAAGCATAAGACGGACTAC
GGCCATGCCGGCGTGACCGTAAAAAAACTGGTCACCGTGATTAAAAAGCACCACCGACAGTTCCTCGGTC
```

FIG. 55 (continued)

SEQ ID NO:30 (continued)

ATGTCCGGAGTCATAATGTAAGACTCGGTAAACACATCAGGTTGGTTAACATCGGTCAGTGCTAAAAAGC
GACCGAAATAGCCCGGGGGAATACATACCCGCAGGCGTAGAGACAACATTACAGCCCCCATAGGAGGTAT
AACAAAATTAATAGGAGAGAAAAACACATAAACCCCTGAAAAACCCTCCTGCCCCTAGGCAAAATAGCAC
CCTCCCGCTCCAGAACAACATACAGCGCTTCCACAGCGGCAGCCATAACAGTCAGCCTTACCAGTAAAAA
AACCTATTAAAAAACACCACTCGACACGGCACCAGCTCAATCAGTCACAGTGTAAAAAGGGCCAAGTACA
GAGCGAGTATATATAGGACTAAAAAATGACGTAACGGTTAAAGTCCACAAAAACCACCCAGAAAACCGCA
CGCGAACCTACGCCCAGAAACGAAAGCCAAAAAACCCACAACTTCCTCAAATCTTCACTTCCGTTTTCCC
ACGATACGTCACTTCCCATTTTAAAAAAAAACTACAATTCCCAATACATGCAAGTTACTCCGCCCTAAAA
CCTACGTCACCCGCCCCGTTCCCACGCCCCGCGCCACGTCACAAACTCCACCCCCTCATTATCATATTGG
CTTCAATCCAAAATAAGGTATATTATTGATGATGGCGAT

FIG. 55 (continued)

SEQ ID NO:31

CGCCATCATCAATAATATACCTTATTTTGGATTGAAGCCAATATGATAATGAGGGGGTGGAGTTTGTGAC
GTGGCGCGGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTTACGTGGAGACTCGCCCAGGTGTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGGTAAAGAGGGAGCGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGTGGTTATTATGA
ATGTGAGGTTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGGTGGTGTGTCGCCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC
GCACCAGGTGCAGACCCTGCGAGTGTGGCGGTAAACATATTAGGAACCAGCCTGTGATGCTGGATGTGAC

FIG. 56

SEQ ID NO:31 (continued)

```
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGGATATGAG
ATGCATCTTGGACTGTATTTTTAGGTTGGCTATGTTCCCAGCCATATCCCTCCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGGATCATGTCTACCTG
CGGGGCGATGAAGAAAACCGTTTCCGGGGTAGGGGAGATCAGCTGGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGGCCACTTCGTTAAGCATGTCCCTGACTTGCATGTTTTCCCT
GACCAAATCCGCCAGAAGGCGCTCGCCGCCCAGCGATAGCAGTTCTTGCAAGGAAGCAAAGTTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGGCGCCGCACGAGGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCTGGTCAGAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGACCCCATGGCATGGGTGGGTGAGCGCGGAGGCG
TACATGCCGCAAATGTCGTAAACGTAGAGGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
CGCGCAGCTTGTTGACCAGCTCGGCGGTGACCTGCACGTCTAGGGCGCAGTAGTCCAGGGTTTCCTTGAT
```

SEQ ID NO:31 (continued)

```
GATGTCATACTTATCCTGTCCCTTTTTTTTCCACAGCTCGCGGTTGAGGACAAACTCTTCGCGGTCTTTC
CAGTACTCTTGGATCGGAAACCCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAAGTCCGTGCGCTTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCCGCGGCGCGACTACGGTACCGCGCGG
CGGGCGGTGGGCCGCGGGGTGTCCTTGGATGATGCATCTAAAAGCGGTGACGCGGGCGGGCCCCCGGAG
GTAGGGGGGGCTCGGGACCCGCCGGGAGAGGGGGCAGGGGCACGTCGGCGCCGCGCGGGCAGGAGCTG
GTGCTGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCCAAGGCCTCAAGGCGCTCCATGGCCTCGTAGAAGTCCACGG
CGAAGTTGAAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGGCCTCTTCTTCTTCTTCAATCTCCTCTTCCATA
AGGGCCTCCCCTTCTTCTTCTTCTGGCGGCGGTGGGGAGGGGGACACGGCGGCGACGACGGCGCACCG
GGAGGCGGTCGACAAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAAGTGCGGCGGCGG
CTGGCGGTAGAGGGCCAGCGTAGGGTGGCCGGGCTCCGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
TAAATTCGCAAGGGTATCATGGCGGACGACCGGGGTTCGAACCCCGGATCCGGCCGTCCGCCGTGATCCA
```

SEQ ID NO:31 (continued)

```
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGTTTGACCCCGTCACTGGTCTTGTCATGCCTGGGGTATATA
CAAACGAAGCCTTCCATCCAGACATCATTTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCGGTGGTGGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTTGGCGCGCCCGCCAGCCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GGCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
ACACCCAGTGCGCGTGCGCGGGCACTACCGCGCGCCTGGGGCGCGCACAAACGCGGCCGCACTGGGCGC
```

SEQ ID NO:31 (continued)

```
ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAGAAGAGATGCTCCAGGTCATCGCGCCGGAGATCTA
TGGCCCCCCGAAGAAGGAAGAGCAGGATTACAAGCCCGAAAGCTAAAGCGGGTCAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCGAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCCGGCGTCCGCGCCGTTCAAGGAAGTACGGCGCCGCCAGCGCGCTACTGCCCGAATATGCCCT
ACATCCTTCCATCGCGCCTACCCCGGCTATCGTGGCTACACCTACCGCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAATAAAAGTCTGGACTCTCACGCTCGCTTGGTCCTGTAACTATTTT
GTAGAATGGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CCGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTTTGGGGTGCAATCCCTGAAGCGCCGACGATGCTTCTGATAGCTAACGTGT
CGTATGTGTGTCATGTATGCGTCCATGTCGCCGCCAGAGGAGCTGCTGAGCCGCCGCGCGCCCGCTTTCC
AAGATGGCTACCCCTTCGATGATGCCGCAGTGGTCTTACATGCACATCTCGGGCCAGGACGCCTCGGAGT
ACCTGAGCCCCGGGCTGGTGCAGTTCGCCCGCGCCACCGAGACGTACTTCAGCCTGAATAACAAGTTTAG
AAACCCCACGGTGGCGCCTACGCACGACGTGACCACAGACCGGTCTCAGCGTTTGACGCTGCGGTTCATC
CCCGTGGACCGCGAGGATACTGCGTACTCGTACAAGGCGCGGTTCACCCTAGCTGTGGGTGATAACCGTG
TGCTAGACATGGCTTCCACGTACTTTGACATCCGCGGCGTGCTGGACAGGGGCCCTACTTTTAAGCCCTA
CTCTGGCACTGCCTACAACGCACTGGCCCCAAGGGTGCCCCAACTCGTGCGAGTGGGAACAAAATGAA
ACTGCACAAGTGGATGCTCAAGAACTTGACGAAGAGGAGAATGAAGCCAATGAAGCTCAGGCGCGAGAAC
AGGAACAAGCTAAGAAACCCATGTATATGCCCAGGCTCCACTGTCCGGAATAAAAATAACTAAAGAAGG
TCTACAAATAGGAACTGCCGACGCCACAGTAGCAGGTGCCGGCAAAGAAATTTTCGCAGACAAAACTTTT
CAACCTGAACCACAAGTAGGAGAATCTCAATGGAACGAAGCGGATGCCACAGCAGCTGGTGGAAGGGTTC
TTAAAAAGACAACTCCCATGAAACCCTGCTATGGCTCATACGCTAGACCCACCAATTCCAACGGCGGACA
GGGCGTTATGGTTGAACAAAATGGTAAATTGGAAAGTCAAGTCGAAATGCAATTTTTTTCCACATCCACA
```

FIG. 56 (continued)

SEQ ID NO:31 (continued)

```
AATGCCACAAATGAAGTTAACAATATACAACCAACAGTTGTATTGTACAGCGAAGATGTAAACATGGAAA
CTCCAGATACTCATCTTTCTTATAAACCTAAAATGGGGGATAAAAATGCCAAAGTCATGCTTGGACAACA
AGCAATGCCAAACAGACCAAATTACATTGCTTTTAGAGACAATTTTATTGGTCTCATGTATTACAACAGC
ACAGGTAACATGGGTGTCCTTGCTGGTCAGGCATCGCAGTTGAACGCTGTTGTAGATTTGCAAGACAGAA
ACACAGAGCTGTCCTACCAGCTTTTGCTTGATTCAATTGGCGACAGAACAAGATACTTTTCAATGTGGAA
TCAAGCTGTTGACAGCTATGATCCAGATGTCAGAATTATTGAGAACCATGGAACTGAGGATGAGTTGCCA
AATTATTGCTTTCCTCTTGGTGGAATTGGGATTACTGACACTTTTCAAGCTGTTAAAACAACTGCTGCTA
ACGGGGACCAAGGCAATACTACCTGGCAAAAAGATTCAACATTTGCAGAACGCAATGAAATAGGGGTGGG
AAATAACTTTGCCATGGAAATTAACCTGAATGCCAACCTATGGAGAAATTTCCTTTACTCCAATATTGCG
CTGTACCTGCCAGACAAGCTAAAATACAACCCCACCAATGTGGAAATATCTGACAACCCCAACACCTACG
ACTACATGAACAAGCGAGTGGTGGCTCCTGGGCTTGTAGACTGCTACATTAACCTTGGGCGCGCTGGTC
TCTGGACTACATGGACAACGTTAATCCCTTTAACCACCCCGCCATGCGGGCCTGCGTTACCGCTCCATG
TTGTTGGGAAACGGCCGCTACGTGCCCTTTCACATTCAGGTGCCCCAAAAGTTTTTTGCCATTAAAAACC
TCCTCCTCCTGCCAGGCTCATACACATATGAATGGAACTTCAGGAAGGATGTTAACATGGTTCTGCAGAG
CTCTCTGGGAAACGACCTTAGAGTTGACGGGGCTAGCATTAAGTTTGACAGCATTTGTCTTTACGCCACC
TTCTTCCCCATGGCCCACAACACGGCCTCCACGCTGGAAGCCATGCTCAGAAATGACACCAACGACCAGT
CCTTTAATGACTACCTTTCCGCCGCCAACATGCTATATCCCATACCCGCCAACGCCACCAACGTGCCCAT
CTCCATCCCATCGCGCAACTGGGCAGCATTTCGCGGTTGGGCCTTCACACGCTTGAAGACAAAGGAAACC
CCTTCCCTGGGATCAGGCTACGACCCTTACTACACCTACTCTGGCTCCATACCATACCTTGACGGAACCT
TCTATCTTAATCACACCTTTAAGAAGGTGGCCATTACTTTTGACTCTTCTGTTAGCTGGCCGGGCAACGA
CCGCCTGCTTACTCCCAATGAGTTTGAGATTAAGCGCTCAGTTGACGGGGAGGGCTATAACGTAGCTCAG
TGCAACATGACAAAGGACTGGTTCCTAGTGCAGATGTTGGCCAACTACAATATTGGCTACCAGGGCTTCT
ACATTCCAGAAAGCTACAAAGACCGCATGTACTCGTTCTTCAGAAACTTCCAGCCCATGAGCCGGCAAGT
GGTGGACGATACTAAATACAAAGATTATCAGCAGGTTGGAATTATCCACCAGCATAACAACTCAGGCTTC
GTAGGCTACCTCGCTCCCACCATGCGCGAGGGACAAGCTTACCCCGCTAATGTTCCCTACCCACTAATAG
GCAAAACCGCGGTTGATAGTATTACCCAGAAAAAGTTTCTTTGCGACCGCACCCTGTGGCGCATCCCCTT
CTCCAGTAACTTTATGTCCATGGGTGCGCTCACAGACCTGGGCCAAAACCTTCTCTACGCAAACTCCGCC
CACGCGCTAGACATGACCTTTGAGGTGGATCCCATGGACGAGCCCACCCTTCTTTATGTTTTGTTTGAAG
TCTTTGACGTGGTCCGTGTGCACCAGCCGCACCGCGGCGTCATCGAGACCGTGTACCTGCGCACGCCCTT
CTCGGCCGGCAACGCCACAACATAAAGAAGCAAGCAACATCAACAACAGCTGCCGCCATGGGCTCCAGTG
AGCAGGAACTGAAAGCCATTGTCAAAGATCTTGGTTGTGGGCCATATTTTTGGGCACCTATGACAAGCG
CTTCCCAGGCTTTGTTTCCCCACACAAGCTCGCCTGCGCCATAGTTAACACGGCCGGTCGCGAGACTGGG
GGCGTACACTGGATGGCCTTTGCCTGGAACCCGCGCTCAAAAACATGCTACCTCTTTGAGCCCTTTGGCT
TTTCTGACCAACGTCTCAAGCAGGTTTACCAGTTTGAGTACGAGTCACTCCTGCGCCGTAGCGCCATTGC
CTCTTCCCCCGACCGCTGTATAACGCTGGAAAAGTCCACCCAAAGCGTGCAGGGGCCCAACTCGGCCGCC
TGTGGCCTATTCTGCTGCATGTTTCTCCACGCCTTTGCCAACTGGCCCCAAACTCCCATGGATCACAACC
CCACCATGAACCTTATTACCGGGGTACCCAACTCCATGCTTAACAGTCCCCAGGTACAGCCCACCCTGCG
CCGCAACCAGGAACAGCTCTACAGCTTCCTGGAGCGCCACTCGCCCTACTTCCGCAGCCACAGTGCGCAA
ATTAGGAGCGCCACTTCTTTTTGTCACTTGAAAAACATGTAAAAATAATGTACTAGGAGACACTTTCAAT
AAAGGCAAATGTTTTTATTTGTACACTCTCGGGTGATTATTTACCCCCACCCTTGCCGTCTGCGCCGTTT
AAAAATCAAAGGGGTTCTGCCGCGCATCGCTATGCGCCACTGGCAGGGACACGTTGCGATACTGGTGTTT
AGTGCTCCACTTAAACTCAGGCACAACCATCCGCGGCAGCTCGGTGAAGTTTTCACTCCACAGGCTGCGC
ACCATCACCAACGCGTTTAGCAGGTCGGGCGCCGATATCTTGAAGTCGCAGTTGGGGCCTCCGCCCTGCG
CGCGCGAGTTGCGATACACAGGGTTACAGCACTGGAACACTATCAGCGCCGGGTGGTGCACGCTGGCCAG
CACGCTCTTGTCGGAGATCANATCCGCGTCCAGGTCCTCCGCGTTGCTCAGGGCGAACGGAGTCAACTTT
GGTAGCTGCCTTCCCAAAAAGGGTGCATGCCCAGGCTTTGAGTTGCACTCGCACCGTAGTGGCATCAGAA
GGTGACCGTGCCCAGTCTGGGCGTTAGGATACAGCGCCTGCATGAAAGCCTTGATCTGCTTAAAAGCCAC
CTGAGCCTTTGCGCCTTCAGAGAAGAACATGCCGCAAGACTTGCCGGAAAACTGATTGGCCGGACAGGCC
GCGTCATGCACGCAGCACCTTGCGTCGGTGTTGGAGATCTGCACCACATTTCGGCCCCACCGGTTCTTCA
CGATCTTGGCCTTGCTAGACTGCTCCTTCAGCGCGCGCTGCCCGTTTTCGCTCGTCACATCCATTTCAAT
CACGTGCTCCTTATTTATCATAATGCTCCCGTGTAGACACTTAAGCTCGCCTTCGATCTCAGCGCAGCGG
TGCAGCCACAACGCGCAGCCCGTGGGCTCGTGGTGCTTGTAGGTTACCTCTGCAAACGACTGCAGGTACG
```

FIG. 56 (continued)

SEQ ID NO:31 (continued)

```
CCTGCAGGAATCGCCCCATCATCGTCACAAAGGTCTTGTTGCTGGTGAAGGTCAGCTGCAACCCGCGGTG
CTCCTCGTTTAGCCAGGTCTTGCATACGGCCGCCAGAGCTTCCACTTGGTCAGGCAGTAGCTTGAAGTTT
GCCTTTAGATCGTTATCCACGTGGTACTTGTCCATCAACGCGCGCGCAGCCTCCATGCCCTTCTCCCACG
CAGACACGATCGGCAGGCTCAGCGGGTTTATCACCGTGCTTTCACTTTCCGCTTCACTGGACTCTTCCTT
TTCCTCTTGCATCCGCATACCCCGCGCCACTGGGTCGTCTTCATTCAGCCGCCGCACCGTGCGCTTACCT
CCCTTGCCGTGCTTGATTAGCACCGGTGGGTTGCTGAAACCCACCATTTGTAGCGCCACATCTTCTCTTT
CTTCCTCGCTGTCCACGATCACCTCTGGGGATGGCGGGCGCTCGGGCTTGGGAGAGGGGCGCTTCTTTTT
CTTTTTGGACGCAATGGCCAAATCCGCCGTCGAGGTCGATGGCCGCGGGCTGGGTGTGCGCGGCACCAGC
GCATCTTGTGACGAGTCTTCTTCGTCCTCGGACTCGAGACGCCGCCTCAGCCGCTTTTTGGGGCGCGC
GGGGAGGCGGCGGCGACGGCGACGGGGACGAGACGTCCTCCATGGTTGGTGGACGTCGCGCCGCACCGCG
TCCGCGCTCGGGGGTGGTTTCGCGCTGCTCCTCTTCCCGACTGGCCATTTCCTTCTCCTATAGGCAGAAA
AAGATCATGGAGTCAGTCGAGAAGGAGGACAGCCTAACCGCCCCCTTTGAGTTCGCCACCACCGCCTCCA
CCGATGCCGCCAACGCGCCTACCACCTTCCCCGTCGAGGCACCCCGCTTGAGGAGGAGGAAGTGATTAT
CGAGCAGGACCCAGGTTTTGTAAGCGAAGACGACGAAGATCGCTCAGTACCAACAGAGGATAAAAGCAA
GACCAGGACGACGCAGAGGCAAACGAGGAACAAGTCGGGCGGGGGACCAAAGGCATGGCGACTACCTAG
ATGTGGGAGACGACGTGCTGTTGAAGCATCTGCAGCGCCAGTGCGCCATTATCTGCGACGCGTTGCAAGA
GCGCAGCGATGTGCCCCTCGCCATAGCGGATGTCAGCCTTGCCTACGAACGCCACCTGTTCTCACCGCGC
GTACCCCCAAACGCCAAGAAAACGGCACATGCGAGCCCAACCCGCGCCTCAACTTCTACCCCGTATTTG
CCGTGCCAGAGGTGCTTGCCACCTATCACATCTTTTTCCAAAACTGCAAGATACCCCTATCCTGCCGTGC
CAACCGCAGCCGAGCGGACAAGCAGCTGGCCTTGCGGCAGGGCGCTGTCATACCTGATATCGCCTCGCTC
GACGAAGTGCCAAAAATCTTTGAGGGTCTTGGACGCGACGAGAAGCGCGCGGCAAACGCTCTGCAACAAG
AAAACAGCGAAAATGAAAGTCACTGTGGAGTGCTGGTGGAACTTGAGGGTGACAACGCGCGCCTAGCCGT
GCTGAAACGCAGCATCGAGGTCACCCACTTTGCCTACCCGGCACTTAACCTACCCCCAAGGTTATGAGC
ACAGTCATGAGCGAGCTGATCGTGCGCCGTGCACGACCCTGGAGAGGGATGCAAACTTGCAAGAACAAA
CCGAGGAGGGCCTACCCGCAGTTGGCGATGAGCAGCTGGCGCGCTGGCTTGAGACGCGCGAGCCTGCCGA
CTTGGAGGAGCGACGCAAGCTAATGATGGCCGCAGTGCTTGTTACCGTGGAGCTTGAGTGCATGCAGCGG
TTCTTTGCTGACCCGGAGATGCAGCGCAAGCTAGAGGAAACGTTGCACTACACCTTTCGCCAGGGCTACG
TGCGCCAGGCCTGCAAAATTTCCAACGTGGAGCTCTGCAACCTGGTCTCCTACCTTGGAATTTTGCACGA
AAACCGCCTTGGGCAAAACGTGCTTCATTCCACGCTCAAGGGCGAGGCGCGCCGCGACTACGTCCGCGAC
TGCGTTTACTTATTTCTGTGCTACACCTGGCAAACGGCCATGGGCGTGTGGCAGCAGTGCCTGGAGGAGC
GCAACCTGAAGGAGCTGCAGAAGCTGCTAAAGCAAAACTTGAAGGACCTATGGACGGCCTTCAACGAGCG
CTCCGTGGCCGCGCACCTGGCGGACATTATCTTCCCCGAACGCCTGCTTAAAACCCTGCAACAGGGTCTG
CCAGACTTCACCAGTCAAAGCATGTTGCAAAACTTTAGGAACTTTATCCTAGAGCGTTCAGGAATTCTGC
CCGCCACCTGCTGTGCGCTTCCTAGCGACTTTGTGCCCATTAAGTACCGTGAATGCCCTCCGCCGCTTTG
GGGTCACTGCTACCTTNTGCAGCTAGCCAACTACCTTGCCTACCACTCCGACATCATGGAAGACGTGAGC
GGTGACGGCCTACTGGAGTGTCACTGTCGCTGCAACCTATGCACCCCGCACCGCTCCTGGTCTGCAATT
CACAACTGCTTAGCGAAAGTCAAATTATCGGTACCTTTGAGCTGCAGGGTCCCTCGCCTGACGAAAAGTC
CGCGGCTCCGGGGTTGAAACTCACTCCGGGGCTGTGGACGTCGGCTTACCTTCGCAAATTTGTACCTGAG
GACTACCACGCCCACGAGATTAGGTTCTACGAAGACCAATCCCGCCCGCCAAATGCGGAGCTTACCGCCT
GCGTCATTACCCAGGGCACATCCTTGGCCAATTGCAAGCCATTAACAAAGCCCGCCAAGAGTTTCTGCT
ACGAAGGGACGGGGGTTTACTTGGACCCCCAGTCCGGCGAGGAGCTCAACCCAATCCCCCGCCGCCG
CAGCCCTATCAGCAGCCGCGGGCCCTTGCTTCCAGGATGGCACCCAAAAAGAAGCTGCAGCTGCCGCCG
CCGCCACCCACGGACGAGGAGGAATACTGGGACAGTCAGGCAGAGGAGGTTTTGGACGAGGAGGAGGAGA
TGATGGAAGACTGGGACAGCCTAGACGAGGAAGCTTCCGAGGCCGAAGAGGTGTCAGACGAAACACCGTC
ACCCTCGGTCGCATTCCCCTCGCCGGCGCCCCAGAAATCGGCAACCGTTCCCAGCATTGCTACAACCTCC
GCTCCTCAGGCGCCGCCGGCACTGCCCGTTCGCCGACCCAACCGTAGATGGGACACCACTGGAACCAGGG
CCGGTAAGTCTAAGCAGCCGCCGCCGTTAGCCCAAGAGCAACAACAGCGCCAAGGCTACCGCTCGTGGCG
CGTGCACAAGAACGCCATAGTTGCTTGCTTGCAAGACTGTGGGGCAACATCTCCTTCGCCCGCCGCTTT
CTTCTCTACCATCACGGCGTGGCCTTCCCCGTAACATCCTGCATTACTACCGTCATCTCTACAGCCCCT
ACTGCACCGGCGGCAGCGGCAGCAACAGCAGCGGCCACGCAGAAGCAAAGGCGACCGGATAGCAAGACTC
TGACAAAGCCCAAGAAATCCACAGCGGCGGCAGCAGCAGGAGGAGGAGCACTGCGTCTGGCGCCCAACGA
ACCCGTATCGACCCGCGAGCTTAGAAACAGGATTTTTCCCACTCTGTATGCTATATTTCAACAGAGCAGG
```

FIG. 56 (continued)

SEQ ID NO:31 (continued)

```
GGCCAAGAACAAGAGCTGAAAATAAAAAACAGGTCTCTGCGCTCCCTCACCCGCAGCTGCCTGTATCACA
AAAGCGAAGATCAGCTTCGGCGCACGCTGGAAGACGCGGAGGCTCTCTTCAGCAAATACTGCGCGCTGAC
TCTTAAGGACTAGTTTCGCGCCCTTTCTCAAATTTAAGCGCGAAAACTACGTCATCTCCAGCGGCCACAC
CCGGCGCCAGCACCTGTCGTCAGCGCCATTATGAGCAAGGAAATTCCCACGCCCTACATGTGGAGTTACC
AGCCACAAATGGGACTTGCGGCTGGAGCTGCCCAAGACTACTCAACCCGAATAAACTACATGAGCGCGGG
ACCCCACATGATATCCCGGGTCAACGGAATCCGCGCCCACCGAAACCGAATTCTCCTCGAACAGGCGGCT
ATTACCACCACACCTCGTAATAACCTTAATCCCCGTAGTTGGCCCGCTGCCCTGGTGTACCAGGAAAGTC
CCGCTCCCACCACTGTGGTACTTCCCAGAGACGCCCAGGCCGAAGTTCAGATGACTAACTCAGGGGCGCA
GCTTGCGGGCGGCTTTCGTCACAGGGTGCGGTCGCCCGGGCAGGGTATAACTCACCTGAAAATCAGAGGG
CGAGGTATTCAGCTCAACGACGAGTCGGTGAGCTCCTCTCTTGGTCTCCGTCCGGACGGGACATTTCAGA
TCGGCGGCGCGTGGCCGCTCTTCATTTACGCCCCGTCAGGCGATCCTAACTCTGCAGACCTCGTCCTCGG
AGCCGCGCTCCGGAGGCATTGGAACTCTACAATTTATTGAGGAGTTCGTGCCTTCGGTTTACTTCAACCC
CTTTTCTGGACCTCCCGGCCACTACCCGGACCAGTTTATTCCCAACTTTGACGCGGTAAAAGACTCGGCG
GACGGCTACGACTGAATGACCAGTGGAGAGGCAGAGCAACTGCGCCTGACACACCTCGACCACTGCCGCC
GCCACAAGTGCTTTGCCCGCGGCTCCGGTGAGTTTTGTTACTTTGAATTGCCCGAAGAGCATATCGAGGG
CCCGGCGCACGGCGTCCGGCTCACCACCCAGGTAGGGATAACAGGGTAATTGAGACATGATTCCTCGAGT
CCTTATATTATTGACCCTTGTTGCGCTTTTCTGTGCGTGCTCTACATTGGCTGCGGTCGCTCACATCGAA
GTAGATTGCATCCCACCTTTCACAGTTTACCTGCTTTACGGATTTGTCACCCTTATCCTCATCTGCAGCC
TCGTCACTGTAGTCATCGCCTTCATTCAGTTCATTGACTGGATTTGTGTGCGCATTGCGTACCTTAGGCA
CCATCCGCAATACAGAGACAGGACTATAGCTGATCTTCTCAGAATTCTTTAATTATGAAACGGATTGTCA
CTTTTGTTTTGCTGATTTTCTGCGCCCTACCTGTGCTTTGCTCCCAAACCTCAGCGCCTCCCAAAAGACA
TATTTCCTGCAGATTCACTCAAATATGGAACATTCCCAGCTGCTACAACAAACAGAGCGATTTGTCAGAA
GCCTGGTTATACGCCATCATCTCTGTCATGGTTTTTTGCAGTACCATTTTTGCCCTAGCCATATACCCAT
ACCTTGACATTGGTTGGAATGCCATAGATGCCATGAACCACCCTACTTTCCCAGCGCCCAATGTCATACC
ACTGCAACAGGTTATTGCCCCAATCAATCAGCCTCGCCCCCTTCTCCCACCCCACTGAGATTAGCTAC
TTTAATTTGACAGGTGGAGATGACTGAATCTCTAGATCTAGAATTGGATGGAATTAACACCGAACAGCGC
CTACTAGAAAGGCGCAAGGCGGCGTCCGAGCGAGAACGCCTAAAACAAGAAGTTGAAGACATGGTTAACC
TGCACCAGTGTAAAAGAGGTATCTTTTGTGTGGTCAAGCAGGCCAAACTTACCTACGAAAAACCACTAC
CGGCAACCGCCTTAGCTACAAGCTACCCACCCAGCGCCAAAAACTGGTGCTTATGGTGGGAGAAAAACCT
ATCACCGTCACCCAGCACTCGGCAGAAACAGAAGGCTGCCTGCACTTCCCTATCAGGGTCCAGAGGACC
TCTGCACTCTTATTAAAACCATGTGTGGCATTAGAGATCTTATTCCATTCAACTAACAATAAACACACAA
TAAATTACTTACTTAAAATCAGTCAGCAAATCTTTGTCCAGCTTATTCAGCATCACCTCCTTTCCCTCCT
CCCAACTCTGGTATTTCAGCAGCCTTTTAGCTGCGAACTTTCTCCAAAGTCTAAATGGGATGTCAAATTC
CTCATGTTCTTGTCCCTCCGCACCCACTATCTTCATATTGTTGCAGATGAAACGCGCCAGACCGTCTGAA
GACACCTTCAACCCTGTGTACCCATATGACACGGAAACCGGCCCTCCAACTGTGCCTTTCCTTACCCCTC
CCTTTGTGTCGCCAAATGGGTTCCAAGAAAGTCCCCCCGGAGTGCTTTCTTTGCGTCTTTCAGAACCTTT
GGTTACCTCACACGGCATGCTTGCGCTAAAAATGGGCAGCGGCCTGTCCCTGGATCAGGCAGGCAACCTT
ACATCAAATACAATCACTGTTTCTCAACCGCTAAAAAAACAAAGTCCAATATAACTTTGGAAACATCCG
CGCCCCTTACAGTCAGCTCAGGCGCCCTAACCATGGCCACAACTTCGCCTTTGGTGGTCTCTGACAACAC
TCTTACCATGCAATCACAAGCACCGCTAACCGTGCAAGACTCAAAACTTAGCATTGCTACCAAAGAGCCA
CTTACAGTGTTAGATGGAAAACTGGCCCTGCAGACATCAGCCCCCTCTCTGCCACTGATAACAACGCCC
TCACTATCACTGCCTCACCTCCTCTTACTACTGCAAATGGTAGTCTGGCTGTTACCATGGAAAACCCACT
TTACAACAACAATGGAAAACTTGGGCTCAAAATTGGCGGTCCTTTGCAAGTGGCCACCGACTCACATGCA
CTAACACTAGGTACTGGTCAGGGGGTTGCAGTTCATAACAATTTGCTACATACAAAAGTTACAGGCGCAA
TAGGGTTTGATACATCTGGCAACATGGAACTTAAAACTGGAGATGGCCTCTATGTGGATAGCGCCGGTCC
TAACCAAAAACTACATATTAATCTAAATACCACAAAAGGCCTTGCTTTTGACAACACCGCAATAACAATT
AACGCTGGAAAAGGGTTGGAATTTGAAACAGACTCCTCAAACGGAAATCCCATAAAAACAAAAATTGGAT
CAGGCATACAATATAATACCAATGGAGCTATGGTTGCAAAACTTGGAACAGGCCTCAGTTTTGACAGCTC
CGGAGCCATAACAATGGGCAGCATAAACAATGACAGACTTACTCTTTGGACAACACCAGACCCATCCCCA
AATTGCAGAATTGCTTCAGATAAAGACTGCAAGCTAACTCTGGCGCTAACAAAATGTGGCAGTCAAATTT
TGGGCACTGTTTCAGCTTTGGCAGTATCAGGTAATATGGCCTCCATCAATGGAACTCTAAGCAGTGTAAA
CTTGGTTCTTAGATTTGATGACAACGGAGTGCTTATGTCAAATTCATCACTGGACAAACAGTATTGGAAC
```

SEQ ID NO:31 (continued)

```
TTTAGAAACGGGGACTCCACTAACGGTCAACCATACACTTATGCTGTTGGGTTTATGCCAAACCTAAAAG
CTTACCCAAAAACTCAAAGTAAAACTGCAAAAAGTAATATTGTTAGCCAGGTGTATCTTAATGGTGACAA
GTCTAAACCATTGCATTTTACTATTACGCTAAATGGAACAGATGAAACCAACCAAGTAAGCAAATACTCA
ATATCATTCAGTTGGTCCTGGAACAGTGGACAATACACTAATGACAAATTTGCCACCAATTCCTATACCT
TCTCCTACATTGCCCAGGAATAAAGAATCGTGAACCTGTTGCATGTTATGTTTCAACGTGTTTATTTTTC
AATTCGTATTAGTCATCGCTATTACCATGGTGATGCGGTTTTGGCAGTACATCAATGGGCGTGGATAGCG
GTTTGACTCACGGGGATTTCCAAGTCTCCACCCCATTGACGTCAATGGGAGTTTGTTTTGGCACCAAAAT
CAACGGGACTTTCCAAAATGTCGTAACAACTCCGCCCCATTGACGCAAATGGGCGGTAGGCGTGTACGGT
GGGAGGTCTATATAAGCAGAGCTGGTTTAGTGAACCGTCAGATCCGCTAGAGATCCACCATGTTTGTCTT
TCTCGTGCTGCTGCCCCTCGTGAGCAGCCAGTGCGTCAATCTGACAACAAGGACCCAGCTGCCCCCGCC
TACACCAACTCCTTCACAAGAGGCGTGTATTACCCCGATAAGGTCTTCAGATCCAGCGTCCTCCACAGCA
CCCAAGATTTGTTTCTGCCTTTCTTCAGCAACGTGACATGGTTCCACGCCATTCATGTCAGCGGCACAAA
CGGCACAAGAGGTTTGACAACCCCGTGCTCCCCTTCAACGACGGCGTGTACTTCGCCAGCACAGAGAAA
TCCAATATCATTAGGGGCTGGATCTTCGGCACAACACTGGATTCCAAGACCCAGTCTCTGCTCATTGTGA
ATAACGCCACCAACGTGGTGATTAAGGTCTGTGAGTTTCAGTTCTGCAACGACCCCTTTCTGGGAGTCTA
CTACCACAAGAATAATAAGAGCTGGATGGAGTCCGAGTTTAGGGTGTACAGCTCCGCCAACAACTGTACC
TTCGAATACGTGTCCCAGCCTTTCCTCATGGATCTGGAGGGCAAGCAAGGCAATTTCAAAAATCTGAGAG
AGTTCGTGTTCAAAAACATTGATGGATACTTCAAAATCTACAGCAAGCATACCCCCATTAATCTGGTGAG
GGATCTGCCCCAAGGATTCTCCGCTCTGGAACCTCTGGTGGATCTGCCCATTGGCATTAACATCACAAGA
TTCCAGACCCTCCTCGCCCTCCATAGATCCTATCTGACCCCCGGCGACTCCTCCAGCGGATGGACAGCCG
GAGCTGCCGCCTACTACGTGGGCTATCTGCAGCCAAGAACCTTTCTGCTGAAGTACAACGAGAACGGCAC
CATCACAGACGCTGTCGATTGCGCTCTCGACCCTCTGAGCGAGACCAAATGCACACTGAAGAGCTTCACC
GTGGAAAAGGGCATCTATCAGACCAGCAACTTCAGAGTGCAGCCTACCGAGAGCATTGTGAGGTTTCCCA
ACATCACCAATCTGTGTCCTTTCGGCGAGGTCTTTAATGCCACAAGGTTCGCTTCCGTGTATGCTTGGAA
TAGGAAGAGGATCAGCAATTGCGTCGCCGACTATTCCGTCCTCTATAACAGCGCCTCCTTCTCCACCTTC
AAATGTTATGGCGTGTCCCCCACCAAGCTCAACGACCTCTGCTTCACCAATGTGTACGCTGACTCCTTCG
TCATTAGGGGCGACGAGGTGAGGCAAATTGCCCCCGGCCAGACCGGCAAGATTGCTGATTACAACTACAA
ACTGCCCGACGATTTTACCGGCTGCGTGATCGCTTGGAACTCCAACAATCTGGACTCCAAAGTGGGCGGA
AACTACAATTACCTCTACAGACTCTTTAGAAAAAGCAATCTGAAGCCCTTCGAGAGAGACATCTCCACCG
AAATCTACCAAGCCGGAAGCACACCTTGCAATGGCGTCGAGGGATTTAACTGCTACTTCCCTCTGCAGAG
CTACGGCTTTCAACCTACCAACGGCGTCGGATATCAACCCTATAGGGTGGTCGTGCTGAGCTTTGAACTG
CTGCATGCTCCCGCCACCGTCTGCGGACCTAAGAAGAGCACCAATCTCGTCAAAAACAAGTGCGTGAACT
TCAACTTCAATGGACTGACCGGCACCGGCGTGCTGACCGAGAGCAATAAGAAGTTTCTGCCCTTCCAGCA
GTTCGGAAGGGATATTGCCGATACCACAGATGCTGTGAGGGACCCCCAAACCCTCGAGATTCTGGATATC
ACCCCTTGCAGCTTCGGAGGAGTGTCCGTGATCACCCCCGGAACAAACACCTCCAATCAAGTGGCTGTGC
TGTACCAAGACGTGAACTGCACAGAAGTCCCCGTGGCCATCCATGCCGACCAGCTGACCCCTACATGGAG
AGTGTACTCCACCGGCAGCAATGTGTTCCAGACAAGAGCCGGATGCCTCATTGGAGCTGAACACGTCAAC
AACAGCTACGAGTGCGACATTCCCATCGGCGCCGGCATTTGTGCCTCCTATCAGACCCAGACCAACAGCC
CAAGAAGGGCTAGAAGCGTCGCTTCCCAATCCATCATTGCCTACACCATGTCTCTGGGAGCCGAAAACTC
CGTCGCCTACTCCAACAATAGCATCGCCATCCCCACCAATTTTACCATCTCCGTGACCACAGAGATTCTG
CCCGTGTCCATGACAAAGACATCCGTGGACTGCACCATGTACATCTGTGGCGACAGCACCGAGTGTAGCA
ATCTGCTGCTGCAATATGGCAGCTTCTGCACCCAGCTGAACAGAGCCCTCACCGGCATCGCCGTCGAACA
AGACAAGAACACCCAAGAGGTGTTCGCCCAAGTGAAGCAAATCTACAAGACCCCCCCTATCAAAGATTTC
GGAGGATTCAACTTTAGCCAGATTCTGCCCGATCCTAGCAAGCCTTCCAAGAGGAGCTTCATCGAGGATC
TGCTGTTTAATAAGGTGACACTGGCCGACGCTGGCTTCATTAAACAGTACGGCGATTGTCTGGGCGACAT
CGCTGCTAGGGATCTGATCTGCGCTCAGAAGTTCAACGGACTGACAGTCCTCCCTCCTCTGCTGACCGAC
GAGATGATCGCTCAGTATACCAGCGCTCTGCTGGCTGGAACCATTACCAGCGGCTGGACATTCGGCGCTG
GAGCCGCCCTCCAAATTCCCTTTGCCATGCAGATGGCCTATAGATTCAACGGCATTGGCGTCACCCAAAA
TGTGCTGTATGAAAATCAGAAGCTGATTGCTAACCAATTCAATAGCGCCATTGGCAAGATCCAAGACTCT
CTGAGCTCCACAGCCAGCGCCCTCGGAAAGCTGCAAGACGTGGTGAATCAAAACGCCCAAGCTCTGAACA
CACTGGTGAAACAGCTCAGCAGCAACTTTGGAGCCATCAGCAGCGTGCTCAATGATATCCTCTCTAGGCT
GGACCCTCCGGAGGCCGAAGTCCAGATCGATAGACTCATCACCGGCAGACTCCAATCTCTGCAGACATAC
```

FIG. 56 (continued)

SEQ ID NO:31 (continued)

```
GTCACCCAACAGCTCATTAGAGCTGCCGAAATCAGAGCCTCCGCCAATCTGGCCGCCACCAAGATGTCCG
AGTGCGTGCTGGGACAGAGCAAGAGAGTGGACTTCTGTGGCAAGGGATACCATCTGATGAGCTTCCCCCA
GAGCGCTCCCCATGGAGTGGTCTTTCTGCATGTCACATACGTGCCCGCCCAAGAGAAGAACTTCACCACC
GCTCCCGCCATTTGCCACGATGGAAAGGCCCACTTTCCCAGAGAAGGAGTGTTCGTGAGCAACGGCACAC
ACTGGTTTGTCACCCAGAGAAATTTTTACGAGCCCCAGATTATCACCACCGACAACACCTTCGTGTCCGG
AAACTGCGATGTCGTGATTGGCATCGTGAACAACACAGTCTACGACCCTCTGCAGCCCGAACTCGACAGC
TTCAAGGAAGAGCTGGACAAGTACTTCAAGAATCACACATCCCCCGACGTGGATCTGGGCGACATTAGCG
GCATTAATGCCTCCGTCGTCAACATTCAGAAGGAGATTGATAGACTGAATGAAGTCGCCAAGAACCTCAA
TGAGTCTCTGATTGATCTGCAAGAGCTGGGCAAGTACGAGCAATACATCAAATGGCCTTGGTACATCTGG
CTGGGATTCATCGCTGGACTCATCGCCATCGTGATGGTCACCATTATGCTGTGTTGCATGACCAGCTGCT
GCAGCTGTCTGAAGGGCTGCTGCAGCTGCGGAAGCTGCTGCAAGTTTGACGAAGACGACTCCGAGCCCGT
GCTGAAGGGCGTCAAGCTGCATTATACATAAACTAGTGCTGGAATTCGCCCTTATAGAGTGCTGGAATTC
GCCCTTATAGAGTGCTGGAATTCGCCCTTATATCTAGTAACGGCCGCCAGTGTGCTGGAATTCGCCCTTA
TAACTTCGTATAGCATACATTATACGAAGTTATAAGGGCGAATTCTGCAGATATCCATCCTTTAAAAAAC
CTCCCACACCTCCCCCTGAACCTGAAACATAAAATGAATGCAATTGTTGTTGTTAACTTGTTTATTGCAG
CTTATAATGGTTACAAATAAAGCAATAGCATCACAAATTTCACAAATAAAGCATTTTTTTCACTGCATTC
TAGTTGTGGTTTGTCCAAACTCATCAATGTATCTTAACAACGTGTTTATTTTTCAATTGCAGAAAGAATT
GCAGAAAATTTCAAGTCATTTTTCATTCAGTAGTATAGCCCCACCACCACATAGCTTATACTAATCACCG
TACCTTAATCAAACTCACAGAACCCTAGTATTCAACCTGCCACCTCCCTCCCAACACACAGAGTACACAG
TCCTTTCTCCCCGGCTGGCCTTAAACAGCATCATATCATGGGTAACAGACATATTCTTAGGTGTTATATT
CCACACGGTCTCCTGTCGAGCCAAACGCTCATCAGTGATGTTAATAAACTCCCCGGGCAGCTCGCTTAAG
TTCATGTCGCTGTCCAGCTGCTGAGCCACAGGCTGCTGTCCAACTTGCGGTTGCTCAACGGGCGGCGAAG
GAGAAGTCCACGCCTACATGGGGGTAGAGTCATAATCGTGCATCAGGATAGGGCGGTGGTGCTGCAGCAG
CGCGCGAATAAACTGCTGCCGCCGCCGCTCCGTCCTGCAGGAATACAACATGGCAGTGGTCTCCTCAGCG
ATGATTCGCACCGCCCGCAGCATAAGGCGCCTTGTCCTCCGGGCACAGCAGCGCACCCTGATCTCACTTA
AGTCAGCACAGTAACTGCAGCACAGTACCACAATATTGTTTAAAATCCCACAGTGCAAGGCGCTGTATCC
AAAGCTCATGGCGGGGACCACAGAACCCACGTGGCCATCATACCACAAGCGCAGGTAGATTAAGTGGCGA
CCCCTCATAAACACGCTGGACATAAACATTACCTCTTTTGGCATGTTGTAATTCACCACCTCCCGGTACC
ATATAAACCTCTGATTAAACATGGCGCCATCCACCACCATCCTAAACCAGCTGGCCAAAACCTGCCCGCC
GGCTATGCACTGCAGGGAACCGGGACTGGAACAATGACAGTGGAGAGCCCAGGACTCGTAACCATGGATC
ATCATGCTCGTCATGATATCAATGTTGGCACAACACAGGCACACGTGCATACACTTCCTCAGGATTACAA
GCTCCTCCCGCGTCAGAACCATATCCCAGGGAACAACCCATTCCTGAATCAGCGTAAATCCCACACTGCA
GGGAAGACCTCGCACGTAACTCACGTTGTGCATTGTCAAAGTGTTACATTCGGGCAGCAGCGGATGATCC
TCCAGTATGGTAGCGCGTGTCTCTGTCTCAAAAGGAGGTAGGCGATCCCTACTGTACGGAGTGCGCCGAG
ACAACCGAGATCGTGTTGGTCGTAGTGTCATGCCAAATGGAACGCCGGACGTAGTCATATTTCCTGAAGC
AAAACCAGGTGCGGGCGTGACAAACAGATCTGCGTCTCCGGTCTCGTCGCTTAGCTCGCTCTGTGTAGTA
GTTGTAGTATATCCACTCTCTCAAAGCATCCAGGCGCCCCTGGCTTCGGGTTCTATGTAAACTCCTTCA
TGCGCCGCTGCCCTGATAACATCCACCACCGCAGAATAAGCCACACCCAGCCAACCTACACATTCGTTCT
GCGAGTCACACACGGGAGGAGCGGGAAGAGCTGGAAGAACCATGTTTTTTTTTTTATTCCAAAAGATTA
TCCAAAACCTCAAAATGAAGATCTATTAAGTGAACGCGCTCCCCTCCGGTGGCGTGGTCAAACTCTACAG
CCAAAGAACAGATAATGGCATTTGTAAGATGTTGCACAATGGCTTCCAAAAGGCAAACTGCCCTCACGTC
CAAGTGGACGTAAAGGCTAAACCCTTCANGGTGAATCTCCTCTATAAACATTCCAGCACCTTCAACCATG
CCCAAATAATTTTCATCTCGCCACCTTATCAATATGTCTCTAAGCAAATCCCGAATATTAAGTCCGGCCA
TTGTAAAAATCTGCTCCAGAGCGCCCTCCACCTTCAGCCTCAAGCAGCGAATCATGATTGCAAAAATTCA
GGTTCCTCACAGACCTGTATAAGATTCAAAAGCGGAACATTAACAAAAATACCGCGATCCCGTAGGTCCC
TTCGCAGGGCCAGCTGAACATAATCGTGCAGGTCTGCACGGACCAGCGCGGCCACTTCCCCGCCAGGAAC
CATGACAAAAGAACCCACACTGATTATGACACGCATACTCGGAGCTATGCTAACCAGCGTAGCCCCGATG
TAAGCTTGTTGCATGGGCGGCGATATAAAATGCAAGGTACTGCTCAAAAAATCAGGCAAAGCCTCGCGCA
AAAAAGCAAGCACATCGTAGTCATGCTCATGCAGATAAAGGCAGGTAAGTTCCGGAACCACCACAGAAAA
AGACACCATTTTTCTCTCAAACATGTCTGCGGGTTCCTGCATAAACACAAAATAAAATAACAAAAAAAAA
AAAACATTTAAACATTAGAAGCCTGTCTTACAACAGGAAAAACAACCCTTATAAGCATAAGACGGACTAC
GGCCATGCCGGCGTGACCGTAAAAAAACTGGTCACCGTGATTAAAAAGCACCACCGACAGTTCCTCGGTC
```

SEQ ID NO:31 (continued)

```
ATGTCCGGAGTCATAATGTAAGACTCGGTAAACACATCAGGTTGGTTAACATCGGTCAGTGCTAAAAAGC
GACCGAAATAGCCCGGGGGAATACATACCCGCAGGCGTAGAGACAACATTACAGCCCCATAGGAGGTAT
AACAAAATTAATAGGAGAGAAAAACACATAAACCCCTGAAAAACCCTCCTGCCCTAGGCAAAATAGCAC
CCTCCCGCTCCAGAACAACATACAGCGCTTCCACAGCGGCAGCCATAACAGTCAGCCTTACCAGTAAAAA
AACCTATTAAAAAACACCACTCGACACGGCACCAGCTCAATCAGTCACAGTGTAAAAAGGGCCAAGTACA
GAGCGAGTATATATAGGACTAAAAAATGACGTAACGGTTAAAGTCCACAAAAACCACCCAGAAAACCGCA
CGCGAACCTACGCCCAGAAACGAAAGCCAAAAAACCCACAACTTCCTCAAATCTTCACTTCCGTTTTCCC
ACGATACGTCACTTCCCATTTTAAAAAAAAACTACAATTCCCAATACATGCAAGTTACTCCGCCCTAAAA
CCTACGTCACCCGCCCCGTTCCCACGCCCCGCGCCACGTCACAAACTCCACCCCCTCATTATCATATTGG
CTTCAATCCAAAATAAGGTATATTATTGATGATGGCGAT
```

FIG. 56 (continued)

SEQ ID NO:32

CGCCATCATCAATAATATACCTTATTTTGGATTGAAGCCAATATGATAATGAGGGGGTGGAGTTTGTGAC
GTGGCGCGGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTTACGTGGAGACTCGCCCAGGTGTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGTAAAGAGGGAGCGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGTGGTTATTATGA
ATGTGAGGTTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGGTGGTGTGTCGCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC
GCACCAGGTGCAGACCCTGCGAGTGTGGCGGTAAACATATTAGGAACCAGCCTGTGATGCTGGATGTGAC

FIG. 57

SEQ ID NO:32 (continued)

```
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGGATATGAG
ATGCATCTTGGACTGTATTTTTAGGTTGGCTATGTTCCCAGCCATATCCCTCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGGATCATGTCTACCTG
CGGGGCGATGAAGAAAACCGTTTCCGGGGTAGGGGAGATCAGCTGGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGCCACTTCGTTAAGCATGTCCCTGACTTGCATGTTTTCCCT
GACCAAATCCGCCAGAAGGCGCTCGCCGCCCAGCGATAGCAGTTCTTGCAAGGAAGCAAAGTTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGGCGCCGCACGAGGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCGGTCAGAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGACCCCATGGCATGGGTGGGTGAGCGCGGAGGCG
TACATGCCGCAAATGTCGTAAACGTAGAGGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
CGCGCAGCTTGTTGACCAGCTCGGCGGTGACCTGCACGTCTAGGGCGCAGTAGTCCAGGGTTTCCTTGAT
```

SEQ ID NO:32 (continued)

```
GATGTCATACTTATCCTGTCCCTTTTTTTTCCACAGCTCGCGGTTGAGGACAAACTCTTCGCGGTCTTTC
CAGTACTCTTGGATCGGAAACCCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAAGTCCGTGCGCTTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCGCGGCGCGACTACGGTACCGCGCGG
CGGGCGGTGGGCCGCGGGGTGTCCTTGGATGATGCATCTAAAAGCGGTGACGCGGGCGGGCCCCCGGAG
GTAGGGGGGGCTCGGGACCCGCCGGGAGAGGGGGCAGGGGCACGTCGGCGCCGCGCGGGCAGGAGCTG
GTGCTGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCAAGGCCTCAAGGCGCTCCATGGCCTCGTAGAAGTCCACGG
CGAAGTTGAAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGGCCTCTTCTTCTTCTTCAATCTCCTCTTCCATA
AGGGCCTCCCCTTCTTCTTCTTCTGGCGGCGGTGGGGAGGGGGACACGGCGGCGACGACGGCGCACCG
GGAGGCGGTCGACAAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAAGTGCGGCGGCGG
CTGGCGGTAGAGGGCCAGCGTAGGGTGGCCGGGCTCCGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
TAAATTCGCAAGGGTATCATGGCGGACGACCGGGGTTCGAACCCCGGATCCGGCCGTCCGCCGTGATCCA
```

SEQ ID NO:32 (continued)

```
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGTTTGACCCCGTCACTGGTCTTGTCATGCCTGGGGTATATA
CAAACGAAGCCTTCCATCCAGACATCATTTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCCGGTGGTGGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTTGGCGCGCCCGCCAGCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GGCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
ACACCCAGTGCGCGTGCGCGGGCACTACCGCGCGCCCTGGGGCGCGCACAAACGCGGCCGCACTGGGCGC
```

FIG. 57 (continued)

SEQ ID NO:32 (continued)

```
ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAAGAAGAGATGCTCCAGGTCATCGCGCCGGAGATCTA
TGGCCCCCCGAAGAAGGAAGAGCAGGATTACAAGCCCGAAAGCTAAAGCGGGTCAAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCGAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCCGGCGTCCGCGCCGTTCAAGGAAGTACGGCGCCGCCAGCGCGCTACTGCCCGAATATGCCCT
ACATCCTTCCATCGCGCCTACCCCGGCTATCGTGGCTACACCTACCGCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAAATAAAAGTCTGGACTCTCACGCTCGCTTGGTCCTGTAACTATTTT
GTAGAATGGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CCGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTCTGGGGTGCAATCCCTGAAGCGCCGACGATGCTTCTGATCGCGGCCGCGA
TATCGCTAGCGAAGTTCCTATTCTCTAGAAAGTATAGGAACTTCTCGATCGAGCACGTGTTGACAATTAA
TCATCGGCATAGTATATCGGCATAGTATAATACGACAAGGTGAGGAACTAAACCATGGCCAAGTTGACCA
GTGCCGTTCCGGTGCTCACCGCGCGCGACGTCGCCGGAGCGGTCGAGTTCTGGACCGACCGGCTCGGGTT
CTCCCGGGACTTCGTGGAGGACGACTTCGCCGGTGTGGTCCGGGACGACGTGACCCTGTTCATCAGCGCG
GTCCAGGACCAGGTGGTGCCGGACAACACCCTGGCCTGGGTGTGGGTGCGCGGCCTGGACGAGCTGTACG
CCGAGTGGTCGGAGGTCGTGTCCACGAACTTCCGGGACGCCTCCGGGCCGGCCATGACCGAGATCGGCGA
GCAGCCGTGGGGCGGGAGTTCGCCCTGCGCGACCCGGCCGGCAACTGCGTGCACTTCGTGGCCGAGGAG
CAGGACTGAGAATTCGAAGTTCCTATTCTCTAGAAAGTATAGGAACTTCGGATCCTCTAGAGTCGATAGC
TAACGTGTCGTATGTGTGTCATGTATGCGTCCATGTCGCCGCCAGAGGAGCTGCTGAGCCGCCGCGCCC
CGCTTTCCAAGATGGCTACCCCTTCGATGATGCCGCAGTGGTCTTACATGCACATCTCGGGCCAGGACGC
CTCGGAGTACCTGAGCCCCGGGCTGGTGCAGTTTGCCCGCGCCACCGAGACGTACTTCAGCCTGAATAAC
AAGTTTAGAAACCCCACGGTGGCGCCTACGCACGACGTGACCACAGACCGGTCCCAGCGTTTGACGCTGC
GGTTCATCCCTGTGGACCGTGAGGATACTGCGTACTCGTACAAGGCGCGGTTCACCCTAGCTGTGGGTGA
```

FIG. 57 (continued)

SEQ ID NO:32 (continued)

```
TAACCGTGTGCTGGACATGGCTTCCACGTACTTTGACATCCGCGGCGTGCTGGACAGGGGCCCCACTTTT
AAGCCCTACTCCGGCACTGCCTACAACGCCCTAGCTCCCAAGGGTGCCCCCAACTCATGCGAGTGGGATG
AAGATGATACTCAGGTACAGGTAGCGGCTGAAGACGATCAAGACGACGACGAAGAAGAGGAACAACTACC
TCAGCAGAGAAATGGCAAAAAAACTCACGTATATGCTCAGGCACCGTTTGCTGGCGAAGCAATTAACAAA
AACGGCCTGCAGATAGGAACTAACGGTGCAGCCACTGAAGGAAATAAGGAAATTTACGCAGATAAAACTT
ATCAACCTGAACCACAAATAGGAGAATCACAGTGGAACGAAGCCGAATCGTCCGTAGCAGGTGGAAGGGT
TCTTAAAAGACTACTCCCATGAAACCATGCTATGGCTCCTATGCCAGACCTACCAATTCTAACGGAGGT
CAGGGCGTTATGGTTGAACAAAATGGTAAATTGGAAAGTCAAGTAGAAATGCAATTTTTTTCAACTTCTG
TAAATGCTATGAACGAGGCAAACGCTATTCAACCTAAACTAGTGTTGTATAGTGAAGATGTAAATATGGA
AACCCCAGACACTCATCTTTCTTATAAGCCTGGAAAAAGTGATGATAATTCTAAGGCAATGTTGGGTCAA
CAATCTATGCCAAACAGACCCAATTACATAGCTTTCAGGGACAATTTTATTGGCCTAATGTATTACAACA
GCACTGGTAACATGGGTGTTCTTGCTGGTCAGGCATCACAGCTAAATGCTGTCGTAGATTTGCAAGACAG
AAACACAGAGCTGTCCTACCAACTTTTGCTTGATTCTATTGGTGATCGAACCAGATACTTTTCCATGTGG
AATCAGGCTGTAGACAGCTACGATCCAGATGTTAGAATTATCGAGAACCATGGAACTGAGGATGAATTGC
CAAATTATTGTTTTCCTCTTGGCGGAATTGGGGTGACGGACACCTATCAAGCTATTAAGGCTACAAATGG
AAATGGAGGCGCCACTACCTGGGCTCAGGACAATACTTTTGCAGAACGAAATGAAATAGGGGTGGGAAAT
AACTTTGCCATGGAAATTAACCTGAATGCCAACCTATGGAGAAATTTCCTTTACTCCAATATTGCGCTGT
ACCTGCCAGACAAGCTAAAATACAACCCCACCAATGTGGAAATATCTGACAATCCCAACACCTACGACTA
CATGAACAAGCGAGTGGTGGCTCCCGGGCTGGTGGATTGCTACATTAACCTTGGGGCGCGCTGGTCTCTG
GACTACATGGACAACGTTAATCCCTTTAACCACCACCGCAATGCGGGCCTGCGTTACCGCTCCATGTTGT
TGGGAAACGGCCGCTACGTGCCCTTTCACATTCAGGTGCCCCAAAAGTTTTTTGCCATTAAAAACCTCCT
CCTCCTGCCAGGCTCATACACATATGAATGGAACTTCAGGAAGGATGTTAACATGGTTCTGCAGAGCTCT
CTGGGAAACGACCTTAGAGTTGACGGGGCTAGCATTAAGTTTGACAGCATTTGTCTTTACGCCACCTTCT
TCCCCATGGCCCACAACACGGCCTCCACGCTGGAAGCCATGCTCAGAAATGACACCAACGACCAGTCCTT
TAATGACTACCTTTCCGCCGCCAACATGCTATATCCCATACCCGCCAACGCCACCAACGTGCCCATCTCC
ATCCCATCGCGCAACTGGGCAGCATTTCGCGGTTGGGCCTTCACACGCTTGAAGACAAAGGAAACCCCTT
CCCTGGGATCAGGCTACGACCCTTACTACACCTACTCTGGCTCCATACCATACCTTGACGGAACCTTCTA
TCTTAATCACACCTTTAAGAAGGTGGCCATTACTTTTGACTCTTCTGTTAGCTGGCCGGGCAACGACCGC
CTGCTTACTCCCAATGAGTTTGAGATTAAGCGCTCAGTTGACGGGGAGGGCTATAACGTAGCTCAGTGCA
ACATGACAAAGGACTGGTTCCTAGTGCAGATGTTGGCCAACTACAATATTGGCTACCAGGGCTTCTACAT
TCCAGAAAGCTACAAAGACCGCATGTACTCGTTCTTCAGAAACTTCCAGCCCATGAGCCGGCAAGTGGTG
GACGATACTAAATACAAAGATTATCAGCAGGTTGGAATTATCCACCAGCATAACAACTCAGGCTTCGTAG
GCTACCTCGCTCCCACCATGCGCGAGGGACAAGCTTACCCCGCTAATGTTCCCTACCCACTAATAGGCAA
AACCGCGGTTGATAGTATTACCCAGAAAAAGTTTCTTTGCGACCGCACCCTGTGGCGCATCCCCTTCTCC
AGTAACTTTATGTCCATGGGTGCGCTCACAGACCTGGGCCAAAACCTTCTCTACGCAAACTCCGCCCACG
CGCTAGACATGACCTTTGAGGTGGATCCCATGGACGAGCCCACCCTTCTTTATGTTTTGTTTGAAGTCTT
TGACGTGGTCCGTGTGCACCAGCCGCACCGCGGCGTCATCGAGACCGTGTACCTGCGCACGCCCTTCTCG
GCCGGCAACGCCACAACATAAAGAAGCAAGCAACATCAACAACAGCTGCCGCCATGGGCTCCAGTGAGCA
GGAACTGAAAGCCATTGTCAAAGATCTTGGTTGTGGGCCATATTTTTGGGCACCTATGACAAGCGCTTC
CCAGGCTTTGTTTCCCCACACAAGCTCGCCTGCGCCATAGTTAACACGGCCGGTCGCGAGACTGGGGCG
TACACTGGATGGCCTTTGCCTGGAACCCGCGCTCAAAAACATGCTACCTCTTTGAGCCCTTTGGCTTTTC
TGACCAACGTCTCAAGCAGGTTTACCAGTTTGAGTACGAGTCACTCCTGCGCCGTAGCGCCATTGCCTCT
TCCCCCGACCGCTGTATAACGCTGGAAAAGTCCACCCAAAGCGTGCAGGGGCCCAACTCGGCCGCCTGTG
GCCTATTCTGCTGCATGTTTCTCCACGCCTTTGCCAACTGGCCCCAAACTCCCATGGATCACAACCCCAC
CATGAACCTTATTACCGGGGTACCCAACTCCATGCTTAACAGTCCCCAGGTACAGCCCACCCTGCGCCGC
AACCAGGAACAGCTCTACAGCTTCCTGGAGCGCCACTCGCCCTACTTCCGCAGCCACAGTGCGCAAATTA
GGAGCGCCACTTCTTTTGTCACTTGAAAAACATGTAAAAATAATGTACTAGGAGACACTTTCAATAAAG
GCAAATGTTTTATTTGTACACTCTCGGGTGATTATTTACCCCACCCTTGCCGTCTGCGCCGTTTAAAA
ATCAAGGGGTTCTGCCGCGCATCGCTATGCGCCACTGGCAGGGACACGTTGCGATACTGGTGTTTAGTG
CTCCACTTAAACTCAGGCACAACCATCCGCGGCAGCTCGGTGAAGTTTTCACTCCACAGGCTGCGCACCA
TCACCAACGCGTTTAGCAGGTCGGGCGCCGATATCTTGAAGTCGCAGTTGGGGCCTCCGCCCTGCGCGCG
CGAGTTGCGATACACAGGGTTACAGCACTGGAACACTATCAGCGCCGGGTGGTGCACGCTGGCCAGCACG
```

SEQ ID NO:32 (continued)

```
CTCTTGTCGGAGATCANATCCGCGTCCAGGTCCTCCGCGTTGCTCAGGGCGAACGGAGTCAACTTTGGTA
GCTGCCTTCCCAAAAAGGGTGCATGCCCAGGCTTTGAGTTGCACTCGCACCGTAGTGGCATCAGAAGGTG
ACCGTGCCCAGTCTGGGCGTTAGGATACAGCGCCTGCATGAAAGCCTTGATCTGCTTAAAAGCCACCTGA
GCCTTTGCGCCTTCAGAGAAGAACATGCCGCAAGACTTGCCGGAAAACTGATTGGCCGGACAGGCCGCGT
CATGCACGCAGCACCTTGCGTCGGTGTTGGAGATCTGCACCACATTTCGGCCCCACCGGTTCTTCACGAT
CTTGGCCTTGCTAGACTGCTCCTTCAGCGCGCGCTGCCCGTTTTCGCTCGTCACATCCATTTCAATCACG
TGCTCCTTATTTATCATAATGCTCCCGTGTAGACACTTAAGCTCGCCTTCGATCTCAGCGCAGCGGTGCA
GCCACAACGCGCAGCCCGTGGGCTCGTGGTGCTTGTAGGTTACCTCTGCAAACGACTGCAGGTACGCCTG
CAGGAATCGCCCCATCATCGTCACAAAGGTCTTGTTGCTGGTGAAGGTCAGCTGCAACCCGCGGTGCTCC
TCGTTTAGCCAGGTCTTGCATACGGCCGCCAGAGCTTCCACTTGGTCAGGCAGTAGCTTGAAGTTTGCCT
TTAGATCGTTATCCACGTGGTACTTGTCCATCAACGCGCGCGCAGCCTCCATGCCCTTCTCCCACGCAGA
CACGATCGGCAGGCTCAGCGGGTTTATCACCGTGCTTTCACTTTCCGCTTCACTGGACTCTTCCTTTTCC
TCTTGCATCCGCATACCCCGCGCCACTGGGTCGTCTTCATTCAGCCGCCGCACCGTGCGCTTACCTCCCT
TGCCGTGCTTGATTAGCACCGGTGGGTTGCTGAAACCCACCATTTGTAGCGCCACATCTTCTCTTTCTTC
CTCGCTGTCCACGATCACCTCTGGGGATGGCGGGCGCTCGGGCTTGGGAGAGGGGCGCTTCTTTTTCTTT
TTGGACGCAATGGCCAAATCCGCCGTCGAGGTCGATGGCCGCGGGCTGGGTGTGCGCGGCACCAGCGCAT
CTTGTGACGAGTCTTCTTCGTCCTCGGACTCGAGACGCCGCCTCAGCCGCTTTTTGGGGCGCGCGGGG
AGGCGGCGGCGACGGCGACGGGACGAGACGTCCTCCATGGTTGGTGGACGTCGCGCCGCACCGCGTCCG
CGCTCGGGGGTGGTTTCGCGCTGCTCCTCTTCCCGACTGGCCATTTCCTTCTCCTATAGGCAGAAAAAGA
TCATGGAGTCAGTCGAGAAGGAGGACAGCCTAACCGCCCCCTTTGAGTTCGCCACCACCGCCTCCACCGA
TGCCGCCAACGCGCCTACCACCTTCCCCGTCGAGGCACCCCGCTTGAGGAGGAGGAAGTGATTATCGAG
CAGGACCCAGGTTTTGTAAGCGAAGACGACGAAGATCGCTCAGTACCAACAGAGGATAAAAAGCAAGACC
AGGACGACGCAGAGGCAAACGAGGAACAAGTCGGGCGGGGGACCAAAGGCATGGCGACTACCTAGATGT
GGGAGACGACGTGCTGTTGAAGCATCTGCAGCGCCAGTGCGCCATTATCTGCGACGCGTTGCAAGAGCGC
AGCGATGTGCCCCTCGCCATAGCGGATGTCAGCCTTGCCTACGAACGCCACCTGTTCTCACCGCGCGTAC
CCCCCAAACGCCAAGAAAACGGCACATGCGAGCCCAACCCGCGCCTCAACTTCTACCCCGTATTTGCCGT
GCCAGAGGTGCTTGCCACCTATCACATCTTTTTCCAAAACTGCAAGATACCCCTATCCTGCCGTGCCAAC
CGCAGCCGAGCGGACAAGCAGCTGGCCTTGCGGCAGGGCGCTGTCATACCTGATATCGCCTCGCTCGACG
AAGTGCCAAAAATCTTTGAGGGTCTTGGACGCGACGAGAAGCGCGCGGCAAACGCTCTGCAACAAGAAAA
CAGCGAAAATGAAAGTCACTGTGGAGTGCTGGTGGAACTTGAGGGTGACAACGCGCGCCTAGCCGTGCTG
AAACGCAGCATCGAGGTCACCCACTTTGCCTACCCGGCACTTAACCTACCCCCAAGGTTATGAGCACAG
TCATGAGCGAGCTGATCGTGCGCCGTGCACGACCCCTGGAGAGGGATGCAAACTTGCAAGAACAAACCGA
GGAGGGCCTACCCGCAGTTGGCGATGAGCAGCTGGCGCGCTGGCTTGAGACGCGCGAGCCTGCCGACTTG
GAGGAGCGACGCAAGCTAATGATGGCCGCAGTGCTTGTTACCGTGGAGCTTGAGTGCATGCAGCGGTTCT
TTGCTGACCCGGAGATGCAGCGCAAGCTAGAGGAAACGTTGCACTACACCTTTCGCCAGGGCTACGTGCG
CCAGGCCTGCAAAATTTCCAACGTGGAGCTCTGCAACCTGGTCTCCTACCTTGGAATTTTGCACGAAAAC
CGCCTTGGGCAAAACGTGCTTCATTCCACGCTCAAGGGCGAGGCGCGCCGCGACTACGTCCGCGACTGCG
TTTACTTATTTCTGTGCTACACCTGGCAAACGGCCATGGGCGTGTGGCAGCAGTGCCTGGAGGAGCGCAA
CCTGAAGGAGCTGCAGAAGCTGCTAAAGCAAAACTTGAAGGACCTATGGACGGCCTTCAACGAGCGCTCC
GTGGCCGCGCACCTGGCGGACATTATCTTCCCCGAACGCCTGCTTAAAACCCTGCAACAGGGTCTGCCAG
ACTTCACCAGTCAAAGCATGTTGCAAAACTTTAGGAACTTTATCCTAGAGCGTTCAGGAATTCTGCCCGC
CACCTGCTGTGCGCTTCCTAGCGACTTTGTGCCCATTAAGTACCGTGAATGCCCTCCGCCGCTTTGGGGT
CACTGCTACCTTNTGCAGCTAGCCAACTACCTTGCCTACCACTCCGACATCATGGAAGACGTGAGCGGTG
ACGGCCTACTGGAGTGTCACTGTCGCTGCAACCTATGCACCCCGCACCGCTCCCTGGTCTGCAATTCACA
ACTGCTTAGCGAAAGTCAAATTATCGGTACCTTTGAGCTGCAGGGTCCCTCGCCTGACGAAAAGTCCGCG
GCTCCGGGGTTGAAACTCACTCCGGGGCTGTGGACGTCGGCTTACCTTCGCAAATTTGTACCTGAGGACT
ACCACGCCCACGAGATTAGGTTCTACGAAGACCAATCCCGCCCGCCAAATGCGGAGCTTACCGCCTGCGT
CATTACCCAGGGCCACATCCTTGGCCAATTGCAAGCCATTAACAAAGCCCGCCAAGAGTTTCTGCTACGA
AAGGGACGGGGGGTTTACTTGGACCCCAGTCCGGCGAGGAGCTCAACCCAATCCCCCGCCGCCGCAGC
CCTATCAGCAGCCGCGGGCCCTTGCTTCCCAGGATGGCACCCAAAAAGAAGCTGCAGCTGCCGCCGCCGC
CACCCACGGACGAGGAGGAATACTGGGACAGTCAGGCAGAGGAGGTTTTGGACGAGGAGGAGGAGATGAT
GGAAGACTGGGACAGCCTAGACGAGGAAGCTTCCGAGGCCGAAGAGGTGTCAGACGAAACACCGTCACCC
```

FIG. 57 (continued)

SEQ ID NO:32 (continued)

```
TCGGTCGCATTCCCCTCGCCGGCGCCCCAGAAATCGGCAACCGTTCCCAGCATTGCTACAACCTCCGCTC
CTCAGGCGCCGCCGGCACTGCCCGTTCGCCGACCCAACCGTAGATGGGACACCACTGGAACCAGGGCCGG
TAAGTCTAAGCAGCCGCCGCCGTTAGCCCAAGAGCAACAACAGCGCCAAGGCTACCGCTCGTGGCGCGTG
CACAAGAACGCCATAGTTGCTTGCTTGCAAGACTGTGGGGGCAACATCTCCTTCGCCCGCCGCTTTCTTC
TCTACCATCACGGCGTGGCCTTCCCCCGTAACATCCTGCATTACTACCGTCATCTCTACAGCCCCTACTG
CACCGGCGGCAGCGGCAGCAACAGCAGCGGCCACGCAGAAGCAAAGGCGACCGGATAGCAAGACTCTGAC
AAAGCCCAAGAAATCCACAGCGGCGGCAGCAGCAGGAGGAGGAGCACTGCGTCTGGCGCCCAACGAACCC
GTATCGACCCGCGAGCTTAGAAACAGGATTTTTCCCACTCTGTATGCTATATTTCAACAGAGCAGGGGCC
AAGAACAAGAGCTGAAAATAAAAAACAGGTCTCTGCGCTCCCTCACCCGCAGCTGCCTGTATCACAAAAG
CGAAGATCAGCTTCGGCGCACGCTGGAAGACGCGGAGGCTCTCTTCAGCAAATACTGCGCGCTGACTCTT
AAGGACTAGTTTCGCGCCCTTTCTCAAATTTAAGCGCGAAAACTACGTCATCTCCAGCGGCCACACCCGG
CGCCAGCACCTGTCGTCAGCGCCATTATGAGCAAGGAAATTCCCACGCCCTACATGTGGAGTTACCAGCC
ACAAATGGGACTTGCGGCTGGAGCTGCCCAAGACTACTCAACCCGAATAAACTACATGAGCGCGGGACCC
CACATGATATCCCGGGTCAACGGAATCCGCGCCCACCGAAACCGAATTCTCCTCGAACAGGCGGCTATTA
CCACCACACCTCGTAATAACCTTAATCCCCGTAGTTGGCCCGCTGCCCTGGTGTACCAGGAAAGTCCCGC
TCCCACCACTGTGGTACTTCCCAGAGACGCCCAGGCCGAAGTTCAGATGACTAACTCAGGGGCGCAGCTT
GCGGGCGGCTTTCGTCACAGGGTGCGGTCGCCCGGGCAGGGTATAACTCACCTGAAAATCAGAGGGCGAG
GTATTCAGCTCAACGACGAGTCGGTGAGCTCCTCTCTTGGTCTCCGTCCGGACGGGACATTTCAGATCGG
CGGCGCTGGCCGCTCTTCATTTACGCCCCGTCAGGCGATCCTAACTCTGCAGACCTCGTCCTCGGAGCCG
CGCTCCGGAGGCATTGGAACTCTACAATTTATTGAGGAGTTCGTGCCTTCGGTTTACTTCAACCCCTTTT
CTGGACCTCCCGGCCACTACCCGGACCAGTTTATTCCCAACTTTGACGCGGTAAAAGACTCGGCGGACGG
CTACGACTGACAGATCTGAGCTCGCGGCCGCGATATCGCTAGCGAAGTTCCTATTCTCTAGAAAGTATAG
GAACTTCGATCCTCTAGAGTCGACCTGCAGGCATGCAAGCTTGGCACTGCAATAAATTACTTACTTAAAA
TCAGTCAGCAAATCTTTGTCCAGCTTATTCAGCATCACCTCCTTTCCCTCCTCCCAACTCTGGTATTTCA
GCAGCCTTTTAGCTGCGAACTTTCTCCAAAGTCTAAATGGGATGTCAAATTCCTCATGTTCTTGTCCCTC
CGCACCCACTATCTTCATATTGTTGCAGATGAAACGCGCCAGACCGTCTGAAGACACCTTCAACCCTGTG
TACCCATATGACACGGAAACCGGCCCTCCAACTGTGCCTTTCCTTACCCCTCCCTTTGTGTCGCCAAATG
GGTTCCAAGAAAGTCCCCCCGGAGTGCTTTCTTTGCGTCTTTCAGAACCTTTGGTTACCTCACACGGCAT
GCTTGCGCTAAAAATGGGCAGCGGCCTGTCCCTGGATCAGGCAGGCAACCTTACATCAAATACAATCACT
GTTTCTCAACCGCTAAAAAAACAAAGTCCAATATAACTTTGGAAACATCCGCGCCCTTACAGTCAGCT
CAGGCGCCCTAACCATGGCCACAACTTCGCCTTTGGTGGTCTCTGACAACACTCTTACCATGCAATCACA
AGCACCGCTAACCGTGCAAGACTCAAAACTTAGCATTGCTACCAAAGAGCCACTTACAGTGTTAGATGGA
AAACTGGCCCTGCAGACATCAGCCCCCCTCTCTGCCACTGATAACAACGCCCTCACTATCACTGCCTCAC
CTCCTCTTACTACTGCAAATGGTAGTCTGGCTGTTACCATGGAAAACCCACTTTACAACAACAATGGAAA
ACTTGGGCTCAAAATTGGCGGTCCTTTGCAAGTGGCCACCGACTCACATGCACTAACACTAGGTACTGGT
CAGGGGGTTGCAGTTCATAACAATTTGCTACATACAAAAGTTACAGGCGCAATAGGGTTTGATACATCTG
GCAACATGGAACTTAAAACTGGAGATGGCCTCTATGTGGATAGCGCCGGTCCTAACCAAAAACTACATAT
TAATCTAAATACCACAAAAGGCCTTGCTTTTGACAACACCGCAATAACAATTAACGCTGGAAAAGGGTTG
GAATTTGAAACAGACTCCTCAAACGGAAATCCCATAAAAACAAAATTGGATCAGGCATACAATATAATA
CCAATGGAGCTATGGTTGCAAAACTTGGAACAGGCCTCAGTTTTGACAGCTCCGGAGCCATAACAATGGG
CAGCATAAACAATGACAGACTTACTCTTTGGACAACACCAGACCCATCCCCAAATTGCAGAATTGCTTCA
GATAAAGACTGCAAGCTAACTCTGGCGCTAACAAAATGTGGCAGTCAAATTTTGGGCACTGTTTCAGCTT
TGGCAGTATCAGGTAATATGGCCTCCATCAATGGAACTCTAAGCAGTGTAAACTTGGTTCTTAGATTTGA
TGACAACGGAGTGCTTATGTCAAATTCATCACTGGACAAACAGTATTGGAACTTTAGAAACGGGGACTCC
ACTAACGGTCAACCATACACTTATGCTGTTGGGTTTATGCCAAACCTAAAAGCTTACCCAAAAACTCAAA
GTAAAACTGCAAAAAGTAATATTGTTAGCCAGGTGTATCTTAATGGTGACAAGTCTAAACCATTGCATTT
TACTATTACGCTAAATGGAACAGATGAAACCAACCAAGTAAGCAAATACTCAATATCATTCAGTTGGTCC
TGGAACAGTGGACAATACACTAATGACAAATTTGCCACCAATTCCTATACCTTCTCCTACATTGCCCAGG
AATAAAGAATCGTGAACCTGTTGCATGTTATGTTTCAACGTGTTTATTTTTCAATTCGTATTAGTCATCG
CTATTACCATGGTGATGCGGTTTTGGCAGTACATCAATGGGCGTGGATAGCGGTTTGACTCACGGGGATT
TCCAAGTCTCCACCCCATTGACGTCAATGGGAGTTTGTTTTGGCACCAAAATCAACGGGACTTTCCAAAA
TGTCGTAACAACTCCGCCCCATTGACGCAAATGGGCGGTAGGCGTGTACGGTGGGAGGTCTATATAAGCA
```

SEQ ID NO:32 (continued)

```
GAGCTGGTTTAGTGAACCGTCAGATCCGCTAGAGATCCACCATGTTTGTCTTTCTCGTGCTGCTGCCCCT
CGTGAGCAGCCAGTGCGTCAATCTGACAACAAGGACCCAGCTGCCCCCGCCTACACCAACTCCTTCACA
AGAGGCGTGTATTACCCCGATAAGGTCTTCAGATCCAGCGTCCTCCACAGCACCCAAGATTTGTTTCTGC
CTTTCTTCAGCAACGTGACATGGTTCCACGCCATTCATGTCAGCGGCACAAACGGCACAAAGAGGTTTGA
CAACCCCGTGCTCCCCTTCAACGACGGCGTGTACTTCGCCAGCACAGAGAAATCCAATATCATTAGGGGC
TGGATCTTCGGCACAACACTGGATTCCAAGACCCAGTCTCTGCTCATTGTGAATAACGCCACCAACGTGG
TGATTAAGGTCTGTGAGTTTCAGTTCTGCAACGACCCCTTTCTGGGAGTCTACTACCACAAGAATAATAA
GAGCTGGATGGAGTCCGAGTTTAGGGTGTACAGCTCCGCCAACAACTGTACCTTCGAATACGTGTCCCAG
CCTTTCCTCATGGATCTGGAGGGCAAGCAAGGCAATTTCAAAAATCTGAGAGAGTTCGTGTTCAAAAACA
TTGATGGATACTTCAAAATCTACAGCAAGCATACCCCCATTAATCTGGTGAGGGATCTGCCCCAAGGATT
CTCCGCTCTGGAACCTCTGGTGGATCTGCCCATTGGCATTAACATCACAAGATTCCAGACCCTCCTCGCC
CTCCATAGATCCTATCTGACCCCCGGCGACTCCTCCAGCGGATGGACAGCCGGAGCTGCCGCCTACTACG
TGGGCTATCTGCAGCCAAGAACCTTTCTGCTGAAGTACAACGAGAACGGCACCATCACAGACGCTGTCGA
TTGCGCTCTCGACCCTCTGAGCGAGACCAAATGCACACTGAAGAGCTTCACCGTGGAAAAGGGCATCTAT
CAGACCAGCAACTTCAGAGTGCAGCCTACCGAGAGCATTGTGAGGTTTCCCAACATCACCAATCTGTGTC
CTTTCGGCGAGGTCTTTAATGCCACAAGGTTCGCTTCCGTGTATGCTTGGAATAGGAAGAGGATCAGCAA
TTGCGTCGCCGACTATTCCGTCCTCTATAACAGCGCCTCCTTCTCCACCTTCAAATGTTATGGCGTGTCC
CCCACCAAGCTCAACGACCTCTGCTTCACCAATGTGTACGCTGACTCCTTCGTCATTAGGGGCGACGAGG
TGAGGCAAATTGCCCCCGGCCAGACCGGCAAGATTGCTGATTACAACTACAAACTGCCCGACGATTTTAC
CGGCTGCGTGATCGCTTGGAACTCCAACAATCTGGACTCCAAAGTGGGCGGAAACTACAATTACCTCTAC
AGACTCTTTAGAAAAAGCAATCTGAAGCCCTTCGAGAGAGACATCTCCACCGAAATCTACCAAGCCGGAA
GCACACCTTGCAATGGCGTCGAGGGATTTAACTGCTACTTCCCTCTGCAGAGCTACGGCTTTCAACCTAC
CAACGGCGTCGGATATCAACCCTATAGGGTGGTCGTGCTGAGCTTTGAACTGCTGCATGCTCCCGCCACC
GTCTGCGGACCTAAGAAGAGCACCAATCTCGTCAAAAACAAGTGCGTGAACTTCAACTTCAATGGACTGA
CCGGCACCGGCGTGCTGACCGAGAGCAATAAGAAGTTTCTGCCCTTCCAGCAGTTCGGAAGGGATATTGC
CGATACCACAGATGCTGTGAGGGACCCCCAAACCCTCGAGATTCTGGATATCACCCCTTGCAGCTTCGGA
GGAGTGTCCGTGATCACCCCCGGAACAAACACCTCCAATCAAGTGGCTGTGCTGTACCAAGACGTGAACT
GCACAGAAGTCCCCGTGGCCATCCATGCCGACCAGCTGACCCCTACATGGAGAGTGTACTCCACCGGCAG
CAATGTGTTCCAGACAAGAGCCGGATGCCTCATTGGAGCTGAACACGTCAACAACAGCTACGAGTGCGAC
ATTCCCATCGGCGCCGGCATTTGTGCCTCCTATCAGACCCAGACCAACAGCCCAAGAAGGGCTAGAAGCG
TCGCTTCCCAATCCATCATTGCCTACACCATGTCTCTGGGAGCCGAAAACTCCGTCGCCTACTCCAACAA
TAGCATCGCCATCCCCACCAATTTTACCATCTCCGTGACCACAGAGATTCTGCCCGTGTCCATGACAAAG
ACATCCGTGGACTGCACCATGTACATCTGTGGCGACAGCACCGAGTGTAGCAATCTGCTGCTGCAATATG
GCAGCTTCTGCACCCAGCTGAACAGAGCCCTCACCGGCATCGCCGTCGAACAAGACAAGAACACCCAAGA
GGTGTTCGCCCAAGTGAAGCAAATCTACAAGACCCCCCCTATCAAAGATTTCGGAGGATTCAACTTTAGC
CAGATTCTGCCCGATCCTAGCAAGCCTTCCAAGAGGAGCTTCATCGAGGATCTGCTGTTTAATAAGGTGA
CACTGGCCGACGCTGGCTTCATTAAACAGTACGGCGATTGTCTGGGCGACATCGCTGCTAGGGATCTGAT
CTGCGCTCAGAAGTTCAACGGACTGACAGTCCTCCCTCCTCTGCTGACCGACGAGATGATCGCTCAGTAT
ACCAGCGCTCTGCTGGCTGGAACCATTACCAGCGGCTGGACATTCGGCGCTGGAGCCGCCCTCCAAATTC
CCTTTGCCATGCAGATGGCCTATAGATTCAACGGCATTGGCGTCACCCAAAATGTGCTGTATGAAAATCA
GAAGCTGATTGCTAACCAATTCAATAGCGCCATTGGCAAGATCCAAGACTCTCTGAGCTCCACAGCCAGC
GCCCTCGGAAAGCTGCAAGACGTGGTGAATCAAAACGCCCAAGCTCTGAACACACTGGTGAAACAGCTCA
GCAGCAACTTTGGAGCCATCAGCAGCGTGCTCAATGATATCCTCTCTAGGCTGGACAAAGTGGAGGCCGA
AGTCCAGATCGATAGACTCATCACCGGCAGACTCCAATCTCTGCAGACATACGTCACCCAACAGCTCATT
AGAGCTGCCGAAATCAGAGCCTCCGCCAATCTGGCCGCCACCAAGATGTCCGAGTGCGTGCTGGGACAGA
GCAAGAGAGTGGACTTCTGTGGCAAGGGATACCATCTGATGAGCTTCCCCCAGAGCGCTCCCCATGGAGT
GGTCTTTCTGCATGTCACATACGTGCCCGCCCAAGAGAAGAACTTCACCACCGCTCCCGCCATTTGCCAC
GATGGAAAGGCCCACTTTCCCAGAGAAGGAGTGTTCGTGAGCAACGGCACACACTGGTTTGTCACCCAGA
GAAATTTTTACGAGCCCCAGATTATCACCACCGACAACACCTTCGTGTCCGGAAACTGCGATGTCGTGAT
TGGCATCGTGAACAACACAGTCTACGACCCTCTGCAGCCCGAACTCGACAGCTTCAAGGAAGAGCTGGAC
AAGTACTTCAAGAATCACACATCCCCGACGTGGATCTGGGCGACATTAGCGGCATTAATGCCTCCGTCG
TCAACATTCAGAAGGAGATTGATAGACTGAATGAAGTCGCCAAGAACCTCAATGAGTCTCTGATTGATCT
```

SEQ ID NO:32 (continued)

```
GCAAGAGCTGGGCAAGTACGAGCAATACATCAAATGGCCTTGGTACATCTGGCTGGGATTCATCGCTGGA
CTCATCGCCATCGTGATGGTCACCATTATGCTGTGTTGCATGACCAGCTGCTGCAGCTGTCTGAAGGGCT
GCTGCAGCTGCGGAAGCTGCTGCAAGTTTGACGAAGACGACTCCGAGCCCGTGCTGAAGGGCGTCAAGCT
GCATTATACATAAACTAGTGCTGGAATTCGCCCTTATAGAGTGCTGGAATTCGCCCTTATAGAGTGCTGG
AATTCGCCCTTATATCTAGTAACGGCCGCCAGTGTGCTGGAATTCGCCCTTATAACTTCGTATAGCATAC
ATTATACGAAGTTATAAGGGCGAATTCTGCAGATATCCATCCTTTAAAAAACCTCCCACACCTCCCCCTG
AACCTGAAACATAAAATGAATGCAATTGTTGTTGTTAACTTGTTTATTGCAGCTTATAATGGTTACAAAT
AAAGCAATAGCATCACAAATTTCACAAATAAAGCATTTTTTTCACTGCATTCTAGTTGTGGTTTGTCCAA
ACTCATCAATGTATCTTAACAACGTGTTTATTTTTCAATTGCAGAAGAATTGCAGAAATTTCAAGTCA
TTTTTCATTCAGTAGTATAGCCCCACCACCACATAGCTTATACTAATCACCGTACCTTAATCAAACTCAC
AGAACCCTAGTATTCAACCTGCCACCTCCCTCCCAACACACAGAGTACACAGTCCTTTCTCCCCGGCTGG
CCTTAAACAGCATCATATCATGGGTAACAGACATATTCTTAGGTGTTATATTCCACACGGTCTCCTGTCG
AGCCAAACGCTCATCAGTGATGTTAATAAACTCCCCGGGCAGCTCGCTTAAGTTCATGTCGCTGTCCAGC
TGCTGAGCCACAGGCTGCTGTCCAACTTGCGGTTGCTCAACGGGCGGCGAAGGAGAAGTCCACGCCTACA
TGGGGGTAGAGTCATAATCGTGCATCAGGATAGGGCGGTGGTGCTGCAGCAGCGCGCGAATAAACTGCTG
CCGCCGCCGCTCCGTCCTGCAGGAATACAACATGGCAGTGGTCTCCTCAGCGATGATTCGCACCGCCCGC
AGCATAAGGCGCCTTGTCCTCCGGGCACAGCAGCGCACCCTGATCTCACTTAAGTCAGCACAGTAACTGC
AGCACAGTACCACAATATTGTTTAAAATCCCACAGTGCAAGGCGCTGTATCCAAAGCTCATGGCGGGGAC
CACAGAACCCACGTGGCCATCATACCACAAGCGCAGGTAGATTAAGTGGCGACCCCTCATAAACACGCTG
GACATAAACATTACCTCTTTTGGCATGTTGTAATTCACCACCTCCCGGTACCATATAAACCTCTGATTAA
ACATGGCGCCATCCACCACCATCCTAAACCAGCTGGCCAAAACCTGCCCGCCGGCTATGCACTGCAGGGA
ACCGGGACTGGAACAATGACAGTGGAGAGCCCAGGACTCGTAACCATGGATCATCATGCTCGTCATGATA
TCAATGTTGGCACAACACAGGCACACGTGCATACACTTCCTCAGGATTACAAGCTCCTCCCGCGTCAGAA
CCATATCCCAGGGAACAACCCATTCCTGAATCAGCGTAAATCCCACACTGCAGGGAAGACCTCGCACGTA
ACTCACGTTGTGCATTGTCAAAGTGTTACATTCGGGCAGCAGCGGATGATCCTCCAGTATGGTAGCGCGT
GTCTCTGTCTCAAAAGGAGGTAGGCGATCCCTACTGTACGGAGTGCGCCGAGACAACCGAGATCGTGTTG
GTCGTAGTGTCATGCCAAATGGAACGCCGGACGTAGTCATATTTCCTGAAGCAAAACCAGGTGCGGGCGT
GACAAACAGATCTGCGTCTCCGGTCTCGTCGCTTAGCTCGCTCTGTGTAGTAGTTGTAGTATATCCACTC
TCTCAAAGCATCCAGGCGCCCCCTGGCTTCGGGTTCTATGTAAACTCCTTCATGCGCCGCTGCCCTGATA
ACATCCACCACCGCAGAATAAGCCACACCCAGCCAACCTACACATTCGTTCTGCGAGTCACACACGGGAG
GAGCGGGAAGAGCTGGAAGAACCATGTTTTTTTTTTTATTCCAAAAGATTATCCAAAACCTCAAAATGA
AGATCTATTAAGTGAACGCGCTCCCCTCCGGTGGCGTGGTCAAACTCTACAGCCAAAGAACAGATAATGG
CATTTGTAAGATGTTGCACAATGGCTTCCAAAAGGCAAACTGCCCTCACGTCCAAGTGGACGTAAAGGCT
AAACCCTTCANGGTGAATCTCCTCTATAAACATTCCAGCACCTTCAACCATGCCCAAATAATTTTCATCT
CGCCACCTTATCAATATGTCTCTAAGCAAATCCCGAATATTAAGTCCGGCCATTGTAAAAATCTGCTCCA
GAGCGCCCTCCACCTTCAGCCTCAAGCAGCGAATCATGATTGCAAAAATTCAGGTTCCTCACAGACCTGT
ATAAGATTCAAAAGCGGAACATTAACAAAATACCGCGATCCCGTAGGTCCCTTCGCAGGGCCAGCTGAA
CATAATCGTGCAGGTCTGCACGGACCAGCGCGGCCACTTCCCCGCCAGGAACCATGACAAAAGAACCCAC
ACTGATTATGACACGCATACTCGGAGCTATGCTAACCAGCGTAGCCCCGATGTAAGCTTGTTGCATGGGC
GGCGATATAAAATGCAAGGTACTGCTCAAAAAATCAGGCAAAGCCTCGCGCAAAAAGCAAGCACATCGT
AGTCATGCTCATGCAGATAAAGGCAGGTAAGTTCCGGAACCACCACAGAAAAGACACCATTTTTCTCTC
AAACATGTCTGCGGGTTCCTGCATAAACACAAAATAAAATAACAAAAAAAAAAAAACATTTAAACATTAG
AAGCCTGTCTTACAACAGGAAAAACAACCCTTATAAGCATAAGACGGACTACGGCCATGCCGGCGTGACC
GTAAAAAAACTGGTCACCGTGATTAAAAAGCACCACCGACAGTTCCTCGGTCATGTCCGGAGTCATAATG
TAAGACTCGGTAAACACATCAGGTTGGTTAACATCGGTCAGTGCTAAAAGCGACCGAAATAGCCCGGGG
GAATACATACCCGCAGGCGTAGAGACAACATTACAGCCCCATAGGAGGTATAACAAAATTAATAGGAGA
GAAAAACACATAAACCCCTGAAAAACCCTCCTGCCCCTAGGCAAAATAGCACCCTCCCGCTCCAGAACAA
CATACAGCGCTTCCACAGCGGCAGCCATAACAGTCAGCCTTACCAGTAAAAAACCTATTAAAAACACC
ACTCGACACGGCACCAGCTCAATCAGTCACAGTGTAAAAAGGGCCAAGTACAGAGCGAGTATATAGGA
CTAAAAAATGACGTAACGGTTAAAGTCCACAAAAACCACCCAGAAAACCGCACGCGAACCTACGCCCAGA
AACGAAAGCCAAAAAACCCACAACTTCCTCAAATCTTCACTTCCGTTTTCCCACGATACGTCACTTCCCA
TTTTAAAAAAAACTACAATTCCCAATACATGCAAGTTACTCCGCCCTAAAACCTACGTCACCCGCCCCG
```

SEQ ID NO:32 (continued)

TTCCCACGCCCCGCGCCACGTCACAAACTCCACCCCCTCATTATCATATTGGCTTCAATCCAAAATAAGG
TATATTATTGATGATGGCGAT

FIG. 57 (continued)

SEQ ID NO:33

```
CGCCATCATCAATAATATACCTTATTTTGGATTGAAGCCAATATGATAATGAGGGGGTGGAGTTTGTGAC
GTGGCGCGGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTTACGTGGAGACTCGCCCAGGTGTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGGTAAAGAGGGAGCGGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGTGGTTATTATGA
ATGTGAGGTTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGGTGGTGTGTCGCCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC
GCACCAGGTGCAGACCCTGCGAGTGTGGCGGTAAACATATTAGGAACCAGCCTGTGATGCTGGATGTGAC
```

FIG. 58

SEQ ID NO:33 (continued)

```
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGGATATGAG
ATGCATCTTGGACTGTATTTTTAGGTTGGCTATGTTCCCAGCCATATCCCTCCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGGATCATGTCTACCTG
CGGGGCGATGAAGAAAACCGTTTCCGGGGTAGGGGAGATCAGCTGGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGGCCACTTCGTTAAGCATGTCCCTGACTTGCATGTTTTCCCT
GACCAAATCCGCCAGAAGGCGCTCGCCGCCCAGCGATAGCAGTTCTTGCAAGGAAGCAAAGTTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGGCGCCGCACGAGGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCTGGTCAGAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGACCCCATGGCATGGGTGGGTGAGCGCGGAGGCG
TACATGCCGCAAATGTCGTAAACGTAGAGGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
CGCGCAGCTTGTTGACCAGCTCGGCGGTGACCTGCACGTCTAGGGCGCAGTAGTCCAGGGTTTCCTTGAT
```

SEQ ID NO:33 (continued)

```
GATGTCATACTTATCCTGTCCCTTTTTTTTCCACAGCTCGCGGTTGAGGACAAACTCTTCGCGGTCTTTC
CAGTACTCTTGGATCGGAAACCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAAGTCCGTGCGCTTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCCGCGGCGCGACTACGGTACCGCGCGG
CGGGCGGTGGGCCGCGGGGTGTCCTTGGATGATGCATCTAAAAGCGGTGACGCGGGCGGGCCCCCGGAG
GTAGGGGGGCTCGGGACCCGCCGGGAGAGGGGGCAGGGGCACGTCGGCGCCGCGCGGGCAGGAGCTG
GTGCTGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCAAGGCCTCAAGGCGCTCCATGGCCTCGTAGAAGTCCACGG
CGAAGTTGAAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGGCCTCTTCTTCTTCTTCAATCTCCTCTTCCATA
AGGGCCTCCCCTTCTTCTTCTTCTGGCGGCGGTGGGGGAGGGGGGACACGGCGGCGACGACGGCGCACCG
GGAGGCGGTCGACAAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAAGTGCGGCGGCGG
CTGGCGGTAGAGGGCCAGCGTAGGGTGGCCGGGCTCCGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
TAAATTCGCAAGGGTATCATGGCGGACGACCGGGGTTCGAACCCCGGATCCGGCCGTCCGCCGTGATCCA
```

FIG. 58 (continued)

SEQ ID NO:33 (continued)

```
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGTTTGACCCCGTCACTGGTCTTGTCATGCCTGGGGTATATA
CAAACGAAGCCTTCCATCCAGACATCATTTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCCGGTGGTGGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTTGGCGCGCCCGCCAGCCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GGCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
ACACCCAGTGCGCGTGCGCGGGCACTACCGCGCGCCCTGGGGCGCGCACAAACGCGGCCGCACTGGGCGC
```

SEQ ID NO:33 (continued)

```
ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAAGAAGAGATGCTCCAGGTCATCGCGCCGGAGATCTA
TGGCCCCCCGAAGAAGGAAGAGCAGGATTACAAGCCCGAAAGCTAAAGCGGGTCAAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCGAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCCGGCGTCCGCGCCGTTCAAGGAAGTACGGCGCCGCCAGCGCGCTACTGCCCGAATATGCCCT
ACATCCTTCCATCGCGCCTACCCCGGCTATCGTGGCTACACCTACCGCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAATAAAAGTCTGGACTCTCACGCTCGCTTGGTCCTGTAACTATTTT
GTAGAATGGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CCGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTCTGGGGTGCAATCCCTGAAGCGCCGACGATGCTTCTGATCGCGGCCGCGA
TATCGCTAGCGAAGTTCCTATTCTCTAGAAAGTATAGGAACTTCTCGATCGAGCACGTGTTGACAATTAA
TCATCGGCATAGTATATCGGCATAGTATAATACGACAAGGTGAGGAACTAAACCATGGCCAAGTTGACCA
GTGCCGTTCCGGTGCTCACCGCGCGCGACGTCGCCGGAGCGGTCGAGTTCTGGACCGACCGGCTCGGGTT
CTCCCGGGACTTCGTGGAGGACGACTTCGCCGGTGTGGTCCGGGACGACGTGACCCTGTTCATCAGCGCG
GTCCAGGACCAGGTGGTGCCGGACAACACCCTGGCCTGGGTGTGGGTGCGCGGCCTGGACGAGCTGTACG
CCGAGTGGTCGGAGGTCGTGTCCACGAACTTCCGGGACGCCTCCGGCCGGCCATGACCGAGATCGGCGA
GCAGCCGTGGGGCGGGAGTTCGCCCTGCGCGACCCGGCCGGCAACTGCGTGCACTTCGTGGCCGAGGAG
CAGGACTGAGAATTCGAAGTTCCTATTCTCTAGAAAGTATAGGAACTTCGGATCCTCTAGAGTCGATAGC
TAACGTGTCGTATGTGTGTCATGTATGCGTCCATGTCGCCGCCAGAGGAGCTGCTGAGCCGCCGCGCGCC
CGCTTTCCAAGATGGCTACCCCTTCGATGATGCCGCAGTGGTCTTACATGCACATCTCGGGCCAGGACGC
CTCGGAGTACCTGAGCCCCGGGCTGGTGCAGTTTGCCCGCGCCACCGAGACGTACTTCAGCCTGAATAAC
AAGTTTAGAAACCCCACGGTGGCGCCTACGCACGACGTGACCACAGACCGGTCCCAGCGTTTGACGCTGC
GGTTCATCCCTGTGGACCGTGAGGATACTGCGTACTCGTACAAGGCGCGGTTCACCCTAGCTGTGGGTGA
```

FIG. 58 (continued)

SEQ ID NO:33 (continued)

```
TAACCGTGTGCTGGACATGGCTTCCACGTACTTTGACATCCGCGGCGTGCTGGACAGGGGCCCCACTTTT
AAGCCCTACTCCGGCACTGCCTACAACGCCCTAGCTCCCAAGGGTGCCCCCAACTCATGCGAGTGGGATG
AAGATGATACTCAGGTACAGGTAGCGGCTGAAGACGATCAAGACGACGACGAAGAAGAGGAACAACTACC
TCAGCAGAGAAATGGCAAAAAAACTCACGTATATGCTCAGGCACCGTTTGCTGGCGAAGCAATTAACAAA
AACGGCCTGCAGATAGGAACTAACGGTGCAGCCACTGAAGGAAATAAGGAAATTTACGCAGATAAAACTT
ATCAACCTGAACCACAAATAGGAGAATCACAGTGGAACGAAGCCGAATCGTCCGTAGCAGGTGGAAGGGT
TCTTAAAAGACTACTCCCATGAAACCATGCTATGGCTCCTATGCCAGACCTACCAATTCTAACGGAGGT
CAGGGCGTTATGGTTGAACAAAATGGTAAATTGGAAAGTCAAGTAGAAATGCAATTTTTTTCAACTTCTG
TAAATGCTATGAACGAGGCAAACGCTATTCAACCTAAACTAGTGTTGTATAGTGAAGATGTAAATATGGA
AACCCCAGACACTCATCTTTCTTATAAGCCTGGAAAAAGTGATGATAATTCTAAGGCAATGTTGGGTCAA
CAATCTATGCCAAACAGACCCAATTACATAGCTTTCAGGGACAATTTTATTGGCCTAATGTATTACAACA
GCACTGGTAACATGGGTGTTCTTGCTGGTCAGGCATCACAGCTAAATGCTGTCGTAGATTTGCAAGACAG
AAACACAGAGCTGTCCTACCAACTTTTGCTTGATTCTATTGGTGATCGAACCAGATACTTTTCCATGTGG
AATCAGGCTGTAGACAGCTACGATCCAGATGTTAGAATTATCGAGAACCATGGAACTGAGGATGAATTGC
CAAATTATTGTTTTCCTCTTGGCGGAATTGGGGTGACGGACACCTATCAAGCTATTAAGGCTACAAATGG
AAATGGAGGCGCCACTACCTGGGCTCAGGACAATACTTTTGCAGAACGAAATGAAATAGGGGTGGGAAAT
AACTTTGCCATGGAAATTAACCTGAATGCCAACCTATGGAGAAATTTCCTTTACTCCAATATTGCGCTGT
ACCTGCCAGACAAGCTAAAATACAACCCCACCAATGTGGAAATATCTGACAATCCCAACACCTACGACTA
CATGAACAAGCGAGTGGTGGCTCCCGGGCTGGTGGATTGCTACATTAACCTTGGGGCGCGCTGGTCTCTG
GACTACATGGACAACGTTAATCCCTTTAACCACCACCGCAATGCGGGCCTGCGTTACCGCTCCATGTTGT
TGGGAAACGGCCGCTACGTGCCCTTTCACATTCAGGTGCCCCAAAAGTTTTTTGCCATTAAAAACCTCCT
CCTCCTGCCAGGCTCATACACATATGAATGGAACTTCAGGAAGGATGTTAACATGGTTCTGCAGAGCTCT
CTGGGAAACGACCTTAGAGTTGACGGGGCTAGCATTAAGTTTGACAGCATTTGTCTTTACGCCACCTTCT
TCCCCATGGCCCACAACACGGCCTCCACGCTGGAAGCCATGCTCAGAAATGACACCAACGACCAGTCCTT
TAATGACTACCTTTCCGCCGCCAACATGCTATATCCCATACCGCCAACGCCACCAACGTGCCCATCTCC
ATCCCATCGCGCAACTGGGCAGCATTTCGCGGTTGGGCCTTCACACGCTTGAAGACAAAGGAAACCCCTT
CCCTGGGATCAGGCTACGACCCTTACTACACCTACTCTGGCTCCATACCATACCTTGACGGAACCTTCTA
TCTTAATCACACCTTTAAGAAGGTGGCCATTACTTTTGACTCTTCTGTTAGCTGGCCGGGCAACGACCGC
CTGCTTACTCCCAATGAGTTTGAGATTAAGCGCTCAGTTGACGGGGAGGGCTATAACGTAGCTCAGTGCA
ACATGACAAAGGACTGGTTCCTAGTGCAGATGTTGGCCAACTACAATATTGGCTACCAGGGCTTCTACAT
TCCAGAAAGCTACAAAGACCGCATGTACTCGTTCTTCAGAAACTTCCAGCCCATGAGCCGGCAAGTGGTG
GACGATACTAAATACAAAGATTATCAGCAGGTTGGAATTATCCACCAGCATAACAACTCAGGCTTCGTAG
GCTACCTCGCTCCCACCATGCGCGAGGGACAAGCTTACCCCGCTAATGTTCCCTACCCACTAATAGGCAA
AACCGCGGTTGATAGTATTACCCAGAAAAAGTTTCTTTGCGACCGCACCCTGTGGCGCATCCCCTTCTCC
AGTAACTTTATGTCCATGGGTGCGCTCACAGACCTGGGCCAAAACCTTCTCTACGCAAACTCCGCCCACG
CGCTAGACATGACCTTTGAGGTGGATCCCATGGACGAGCCCACCCTTCTTTATGTTTTGTTTGAAGTCTT
TGACGTGGTCCGTGTGCACCAGCCGCACCGCGGCGTCATCGAGACCGTGTACCTGCGCACGCCCTTCTCG
GCCGGCAACGCCACAACATAAAGAAGCAAGCAACATCAACAACAGCTGCCGCCATGGGCTCCAGTGAGCA
GGAACTGAAAGCCATTGTCAAAGATCTTGGTTGTGGGCCATATTTTTGGGCACCTATGACAAGCGCTTC
CCAGGCTTTGTTTCCCCACACAAGCTCGCCTGCGCCATAGTTAACACGGCCGGTCGCGAGACTGGGGGCG
TACACTGGATGGCCTTTGCCTGGAACCCGCGCTCAAAAACATGCTACCTCTTTGAGCCCTTTGGCTTTTC
TGACCAACGTCTCAAGCAGGTTTACCAGTTTGAGTACGAGTCACTCCTGCGCCGTAGCGCCATTGCCTCT
TCCCCCGACCGCTGTATAACGCTGGAAAAGTCCACCCAAAGCGTGCAGGGGCCCAACTCGGCCGCCTGTG
GCCTATTCTGCTGCATGTTTCTCCACGCCTTTGCCAACTGGCCCCAAACTCCCATGGATCACAACCCCAC
CATGAACCTTATTACCGGGGTACCCAACTCCATGCTTAACAGTCCCCAGGTACAGCCCACCCTGCGCCGC
AACCAGGAACAGCTCTACAGCTTCCTGGAGCGCCACTCGCCCTACTTCCGCAGCCACAGTGCGCAAATTA
GGAGCGCCACTTCTTTTGTCACTTGAAAAACATGTAAAAATAATGTACTAGGAGACACTTTCAATAAAG
GCAAATGTTTTATTTGTACACTCTCGGGTGATTATTTACCCCACCCTTGCCGTCTGCGCCGTTTAAAA
ATCAAGGGGTTCTGCCGCGCATCGCTATGCGCCACTGGCAGGGACACGTTGCGATACTGGTGTTTAGTG
CTCCACTTAAACTCAGGCACAACCATCCGCGGCAGCTCGGTGAAGTTTTCACTCCACAGGCTGCGCACCA
TCACCAACGCGTTTAGCAGGTCGGGCGCCGATATCTTGAAGTCGCAGTTGGGGCCTCCGCCCTGCGCGCG
CGAGTTGCGATACACAGGGTTACAGCACTGGAACACTATCAGCGCCGGGTGGTGCACGCTGGCCAGCACG
```

SEQ ID NO:33 (continued)

```
CTCTTGTCGGAGATCANATCCGCGTCCAGGTCCTCCGCGTTGCTCAGGGCGAACGGAGTCAACTTTGGTA
GCTGCCTTCCCAAAAAGGGTGCATGCCCAGGCTTTGAGTTGCACTCGCACCGTAGTGGCATCAGAAGGTG
ACCGTGCCCAGTCTGGGCGTTAGGATACAGCGCCTGCATGAAAGCCTTGATCTGCTTAAAAGCCACCTGA
GCCTTTGCGCCTTCAGAGAAGAACATGCCGCAAGACTTGCCGGAAAACTGATTGGCCGGACAGGCCGCGT
CATGCACGCAGCACCTTGCGTCGGTGTTGGAGATCTGCACCACATTTCGGCCCCACCGGTTCTTCACGAT
CTTGGCCTTGCTAGACTGCTCCTTCAGCGCGCGCTGCCCGTTTTCGCTCGTCACATCCATTTCAATCACG
TGCTCCTTATTTATCATAATGCTCCCGTGTAGACACTTAAGCTCGCCTTCGATCTCAGCGCAGCGGTGCA
GCCACAACGCGCAGCCCGTGGGCTCGTGGTGCTTGTAGGTTACCTCTGCAAACGACTGCAGGTACGCCTG
CAGGAATCGCCCCATCATCGTCACAAAGGTCTTGTTGCTGGTGAAGGTCAGCTGCAACCCGCGGTGCTCC
TCGTTTAGCCAGGTCTTGCATACGGCCGCCAGAGCTTCCACTTGGTCAGGCAGTAGCTTGAAGTTTGCCT
TTAGATCGTTATCCACGTGGTACTTGTCCATCAACGCGCGCGCAGCCTCCATGCCCTTCTCCCACGCAGA
CACGATCGGCAGGCTCAGCGGGTTTATCACCGTGCTTTCACTTTCCGCTTCACTGGACTCTTCCTTTTCC
TCTTGCATCCGCATACCCCGCGCCACTGGGTCGTCTTCATTCAGCCGCCGCACCGTGCGCTTACCTCCCT
TGCCGTGCTTGATTAGCACCGGTGGGTTGCTGAAACCCACCATTTGTAGCGCCACATCTTCTCTTTCTTC
CTCGCTGTCCACGATCACCTCTGGGGATGGCGGGCGCTCGGGCTTGGGAGAGGGGCGCTTCTTTTTCTTT
TTGGACGCAATGGCCAAATCCGCCGTCGAGGTCGATGGCCGCGGGCTGGGTGTGCGCGGCACCAGCGCAT
CTTGTGACGAGTCTTCTTCGTCCTCGGACTCGAGACGCCGCCTCAGCCGCTTTTTTGGGGCGCGCGGGG
AGGCGGCGGCGACGGCGACGGGGACGAGACGTCCTCCATGGTTGGTGGACGTCGCGCCGCACCGCGTCCG
CGCTCGGGGGTGGTTTCGCGCTGCTCCTCTTCCCGACTGGCCATTTCCTTCTCCTATAGGCAGAAAAAGA
TCATGGAGTCAGTCGAGAAGGAGGACAGCCTAACCGCCCCCTTTGAGTTCGCCACCACCGCCTCCACCGA
TGCCGCCAACGCGCCTACCACCTTCCCCGTCGAGGCACCCCGCTTGAGGAGGAGGAAGTGATTATCGAG
CAGGACCCAGGTTTTGTAAGCGAAGACGACGAAGATCGCTCAGTACCAACAGAGGATAAAAAGCAAGACC
AGGACGACGCAGAGGCAAACGAGGAACAAGTCGGGCGGGGGACCAAAGGCATGGCGACTACCTAGATGT
GGGAGACGACGTGCTGTTGAAGCATCTGCAGCGCCAGTGCGCCATTATCTGCGACGCGTTGCAAGAGCGC
AGCGATGTGCCCCTCGCCATAGCGGATGTCAGCCTTGCCTACGAACGCCACCTGTTCTCACCGCGCGTAC
CCCCCAAACGCCAAGAAAACGGCACATGCGAGCCCAACCCGCGCCTCAACTTCTACCCCGTATTTGCCGT
GCCAGAGGTGCTTGCCACCTATCACATCTTTTTCCAAAACTGCAAGATACCCCTATCCTGCCGTGCCAAC
CGCAGCCGAGCGGACAAGCAGCTGGCCTTGCGGCAGGGCGCTGTCATACCTGATATCGCCTCGCTCGACG
AAGTGCCAAAAATCTTTGAGGGTCTTGGACGCGACGAGAAGCGCGCGGCAAACGCTCTGCAACAAGAAAA
CAGCGAAAATGAAAGTCACTGTGGAGTGCTGGTGGAACTTGAGGGTGACAACGCGCGCCTAGCCGTGCTG
AAACGCAGCATCGAGGTCACCCACTTTGCCTACCCGGCACTTAACCTACCCCCAAGGTTATGAGCACAG
TCATGAGCGAGCTGATCGTGCGCCGTGCACGACCCCTGGAGAGGGATGCAAACTTGCAAGAACAAACCGA
GGAGGGCCTACCCGCAGTTGGCGATGAGCAGCTGGCGCGCTGGCTTGAGACGCGCGAGCCTGCCGACTTG
GAGGAGCGACGCAAGCTAATGATGGCCGCAGTGCTTGTTACCGTGGAGCTTGAGTGCATGCAGCGGTTCT
TTGCTGACCCGGAGATGCAGCGCAAGCTAGAGGAAACGTTGCACTACACCTTTCGCCAGGGCTACGTGCG
CCAGGCCTGCAAAATTTCCAACGTGGAGCTCTGCAACCTGGTCTCCTACCTTGGAATTTTGCACGAAAAC
CGCCTTGGGCAAAACGTGCTTCATTCCACGCTCAAGGGCGAGGCGCGCCGCGACTACGTCCGCGACTGCG
TTTACTTATTTCTGTGCTACACCTGGCAAACGGCCATGGGCGTGTGGCAGCAGTGCCTGGAGGAGCGCAA
CCTGAAGGAGCTGCAGAAGCTGCTAAAGCAAAACTTGAAGGACCTATGGACGGCCTTCAACGAGCGCTCC
GTGGCCGCGCACCTGGCGGACATTATCTTCCCCGAACGCCTGCTTAAAACCCTGCAACAGGGTCTGCCAG
ACTTCACCAGTCAAAGCATGTTGCAAAACTTTAGGAACTTTATCCTAGAGCGTTCAGGAATTCTGCCCGC
CACCTGCTGTGCGCTTCCTAGCGACTTTGTGCCCATTAAGTACCGTGAATGCCCTCCGCCGCTTTGGGGT
CACTGCTACCTTNTGCAGCTAGCCAACTACCTTGCCTACCACTCCGACATCATGGAAGACGTGAGCGGTG
ACGGCCTACTGGAGTGTCACTGTCGCTGCAACCTATGCACCCCGCACCGCTCCCTGGTCTGCAATTCACA
ACTGCTTAGCGAAAGTCAAATTATCGGTACCTTTGAGCTGCAGGGTCCCTCGCCTGACGAAAGTCCGCG
GCTCCGGGGTTGAAACTCACTCCGGGGCTGTGGACGTCGGCTTACCTTCGCAAATTTGTACCTGAGGACT
ACCACGCCCACGAGATTAGGTTCTACGAAGACCAATCCCGCCCGCCAAATGCGGAGCTTACCGCCTGCGT
CATTACCCAGGGCCACATCCTTGGCCAATTGCAAGCCATTAACAAAGCCCGCCAAGAGTTTCTGCTACGA
AAGGGACGGGGGGTTTACTTGGACCCCAGTCCGGCGAGGAGCTCAACCCAATCCCCCCGCCGCCGCAGC
CCTATCAGCAGCCGCGGGCCCTTGCTTCCCAGGATGGCACCCAAAAAGAAGCTGCAGCTGCCGCCGCCGC
CACCCACGGACGAGGAGGAATACTGGGACAGTCAGGCAGAGGAGGTTTTGGACGAGGAGGAGGAGATGAT
GGAAGACTGGGACAGCCTAGACGAGGAAGCTTCCGAGGCCGAAGAGGTGTCAGACGAAACACCGTCACCC
```

FIG. 58 (continued)

SEQ ID NO:33 (continued)

```
TCGGTCGCATTCCCCTCGCCGGCGCCCCAGAAATCGGCAACCGTTCCCAGCATTGCTACAACCTCCGCTC
CTCAGGCGCCGCCGGCACTGCCCGTTCGCCGACCCAACCGTAGATGGGACACCACTGGAACCAGGGCCGG
TAAGTCTAAGCAGCCGCCGCCGTTAGCCCAAGAGCAACAACAGCGCCAAGGCTACCGCTCGTGGCGCGTG
CACAAGAACGCCATAGTTGCTTGCTTGCAAGACTGTGGGGGCAACATCTCCTTCGCCCGCCGCTTTCTTC
TCTACCATCACGGCGTGGCCTTCCCCCGTAACATCCTGCATTACTACCGTCATCTCTACAGCCCCTACTG
CACCGGCGGCAGCGGCAGCAACAGCAGCGGCCACGCAGAAGCAAAGGCGACCGGATAGCAAGACTCTGAC
AAAGCCCAAGAAATCCACAGCGGCGGCAGCAGCAGGAGGAGGAGCACTGCGTCTGGCGCCCAACGAACCC
GTATCGACCCGCGAGCTTAGAAACAGGATTTTTCCCACTCTGTATGCTATATTTCAACAGAGCAGGGGCC
AAGAACAAGAGCTGAAAATAAAAAACAGGTCTCTGCGCTCCCTCACCCGCAGCTGCCTGTATCACAAAAG
CGAAGATCAGCTTCGGCGCACGCTGGAAGACGCGGAGGCTCTCTTCAGCAAATACTGCGCGCTGACTCTT
AAGGACTAGTTTCGCGCCCTTTCTCAAATTTAAGCGCGAAAACTACGTCATCTCCAGCGGCCACACCCGG
CGCCAGCACCTGTCGTCAGCGCCATTATGAGCAAGGAAATTCCACGCCCTACATGTGGAGTTACCAGCC
ACAAATGGGACTTGCGGCTGGAGCTGCCCAAGACTACTCAACCCGAATAAACTACATGAGCGCGGGACCC
CACATGATATCCCGGGTCAACGGAATCCGCGCCCACCGAAACCGAATTCTCCTCGAACAGGCGGCTATTA
CCACCACACCTCGTAATAACCTTAATCCCCGTAGTTGGCCCGCTGCCCTGGTGTACCAGGAAAGTCCCGC
TCCCACCACTGTGGTACTTCCCAGAGACGCCCAGGCCGAAGTTCAGATGACTAACTCAGGGGCGCAGCTT
GCGGGCGGCTTTCGTCACAGGGTGCGGTCGCCCGGGCAGGGTATAACTCACCTGAAAATCAGAGGGCGAG
GTATTCAGCTCAACGACGAGTCGGTGAGCTCCTCTCTTGGTCTCCGTCCGGACGGGACATTTCAGATCGG
CGGCGCTGGCCGCTCTTCATTTACGCCCCGTCAGGCGATCCTAACTCTGCAGACCTCGTCCTCGGAGCCG
CGCTCCGGAGGCATTGGAACTCTACAATTTATTGAGGAGTTCGTGCCTTCGGTTTACTTCAACCCCTTTT
CTGGACCTCCCGGCCACTACCCGGACCAGTTTATTCCCAACTTTGACGCGGTAAAAGACTCGGCGGACGG
CTACGACTGACAGATCTGAGCTCGCGGCCGCGATATCGCTAGCGAAGTTCCTATTCTCTAGAAAGTATAG
GAACTTCGATCCTCTAGAGTCGACCTGCAGGCATGCAAGCTTGGCACTGCAATAAATTACTTACTTAAAA
TCAGTCAGCAAATCTTTGTCCAGCTTATTCAGCATCACCTCCTTTCCCTCCTCCCAACTCTGGTATTTCA
GCAGCCTTTTAGCTGCGAACTTTCTCCAAAGTCTAAATGGGATGTCAAATTCCTCATGTTCTTGTCCCTC
CGCACCCACTATCTTCATATTGTTGCAGATGAAACGCGCCAGACCGTCTGAAGACACCTTCAACCCTGTG
TACCCATATGACACGGAAACCGGCCCTCCAACTGTGCCTTTCCTTACCCCTCCCTTTGTGTCGCCAAATG
GGTTCCAAGAAAGTCCCCCGGAGTGCTTTCTTTGCGTCTTTCAGAACCTTTGGTTACCTCACACGGCAT
GCTTGCGCTAAAAATGGGCAGCGGCCTGTCCTGGATCAGGCAGGCAACCTTACATCAAATACAATCACT
GTTTCTCAACCGCTAAAAAAACAAAGTCCAATATAACTTTGGAAACATCCGCGCCCTTACAGTCAGCT
CAGGCGCCCTAACCATGGCCACAACTTCGCCTTTGGTGGTCTCTGACAACACTCTTACCATGCAATCACA
AGCACCGCTAACCGTGCAAGACTCAAAACTTAGCATTGCTACCAAAGAGCCACTTACAGTGTTAGATGGA
AAACTGGCCCTGCAGACATCAGCCCCCCTCTCTGCCACTGATAACAACGCCCTCACTATCACTGCCTCAC
CTCCTCTTACTACTGCAAATGGTAGTCTGGCTGTTACCATGGAAAACCCACTTTACAACAACAATGGAAA
ACTTGGGCTCAAAATTGGCGGTCCTTTGCAAGTGGCCACCGACTCACATGCACTAACACTAGGTACTGGT
CAGGGGGTTGCAGTTCATAACAATTTGCTACATACAAAAGTTACAGGCGCAATAGGGTTTGATACATCTG
GCAACATGGAACTTAAAACTGGAGATGGCCTCTATGTGGATAGCGCCGGTCCTAACCAAAAACTACATAT
TAATCTAAATACCACAAAAGGCCTTGCTTTTGACAACACCGCAATAACAATTAACGCTGGAAAAGGGTTG
GAATTTGAAACAGACTCCTCAAACGGAAATCCCATAAAAACAAAATTGGATCAGGCATACAATATAATA
CCAATGGAGCTATGGTTGCAAAACTTGGAACAGGCCTCAGTTTTGACAGCTCCGGAGCCATAACAATGGG
CAGCATAAACAATGACAGACTTACTCTTTGGACAACACCAGACCCATCCCCAAATTGCAGAATTGCTTCA
GATAAAGACTGCAAGCTAACTCTGGCGCTAACAAAATGTGGCAGTCAAATTTTGGGCACTGTTTCAGCTT
TGGCAGTATCAGGTAATATGGCCTCCATCAATGGAACTCTAAGCAGTGTAAACTTGGTTCTTAGATTTGA
TGACAACGGAGTGCTTATGTCAAATTCATCACTGGACAAACAGTATTGGAACTTTAGAAACGGGGACTCC
ACTAACGGTCAACCATACACTTATGCTGTTGGGTTTATGCCAAACCTAAAAGCTTACCCAAAAACTCAAA
GTAAAACTGCAAAAAGTAATATTGTTAGCCAGGTGTATCTTAATGGTGACAAGTCTAAACCATTGCATTT
TACTATTACGCTAAATGGAACAGATGAAACCAACCAAGTAAGCAAATACTCAATATCATTCAGTTGGTCC
TGGAACAGTGGACAATACACTAATGACAAATTTGCCACCAATTCCTATACCTTCTCCTACATTGCCCAGG
AATAAAGAATCGTGAACCTGTTGCATGTTATGTTTCAACGTGTTTATTTTTCAATTCGTATTAGTCATCG
CTATTACCATGGTGATGCGGTTTTGGCAGTACATCAATGGGCGTGGATAGCGGTTTGACTCACGGGGATT
TCCAAGTCTCCACCCCATTGACGTCAATGGGAGTTTGTTTTGGCACCAAAATCAACGGGACTTTCCAAAA
TGTCGTAACAACTCCGCCCCATTGACGCAAATGGGCGGTAGGCGTGTACGGTGGGAGGTCTATATAAGCA
```

FIG. 58 (continued)

SEQ ID NO:33 (continued)

```
GAGCTGGTTTAGTGAACCGTCAGATCCGCTAGAGATCCACCATGTTTGTCTTTCTCGTGCTGCTGCCCCT
CGTGAGCAGCCAGTGCGTCAATCTGACAACAAGGACCCAGCTGCCCCCGCCTACACCAACTCCTTCACA
AGAGGCGTGTATTACCCCGATAAGGTCTTCAGATCCAGCGTCCTCCACAGCACCCAAGATTTGTTTCTGC
CTTTCTTCAGCAACGTGACATGGTTCCACGCCATTCATGTCAGCGGCACAAACGGCACAAAGAGGTTTGA
CAACCCCGTGCTCCCCTTCAACGACGGCGTGTACTTCGCCAGCACAGAGAAATCCAATATCATTAGGGGC
TGGATCTTCGGCACAACACTGGATTCCAAGACCCAGTCTCTGCTCATTGTGAATAACGCCACCAACGTGG
TGATTAAGGTCTGTGAGTTTCAGTTCTGCAACGACCCCTTTCTGGGAGTCTACTACCACAAGAATAATAA
GAGCTGGATGGAGTCCGAGTTTAGGGTGTACAGCTCCGCCAACAACTGTACCTTCGAATACGTGTCCCAG
CCTTTCCTCATGGATCTGGAGGGCAAGCAAGGCAATTTCAAAAATCTGAGAGAGTTCGTGTTCAAAAACA
TTGATGGATACTTCAAAATCTACAGCAAGCATACCCCCATTAATCTGGTGAGGGATCTGCCCCAAGGATT
CTCCGCTCTGGAACCTCTGGTGGATCTGCCCATTGGCATTAACATCACAAGATTCCAGACCCTCCTCGCC
CTCCATAGATCCTATCTGACCCCCGGCGACTCCTCCAGCGGATGGACAGCCGGAGCTGCCGCCTACTACG
TGGGCTATCTGCAGCCAAGAACCTTTCTGCTGAAGTACAACGAGAACGGCACCATCACAGACGCTGTCGA
TTGCGCTCTCGACCCTCTGAGCGAGACCAAATGCACACTGAAGAGCTTCACCGTGGAAAAGGGCATCTAT
CAGACCAGCAACTTCAGAGTGCAGCCTACCGAGAGCATTGTGAGGTTTCCCAACATCACCAATCTGTGTC
CTTTCGGCGAGGTCTTTAATGCCACAAGGTTCGCTTCCGTGTATGCTTGGAATAGGAAGAGGATCAGCAA
TTGCGTCGCCGACTATTCCGTCCTCTATAACAGCGCCTCCTTCTCCACCTTCAAATGTTATGGCGTGTCC
CCCACCAAGCTCAACGACCTCTGCTTCACCAATGTGTACGCTGACTCCTTCGTCATTAGGGGCGACGAGG
TGAGGCAAATTGCCCCCGGCCAGACCGGCAAGATTGCTGATTACAACTACAAACTGCCCGACGATTTTAC
CGGCTGCGTGATCGCTTGGAACTCCAACAATCTGGACTCCAAAGTGGGCGGAAACTACAATTACCTCTAC
AGACTCTTTAGAAAAAGCAATCTGAAGCCCTTCGAGAGAGACATCTCCACCGAAATCTACCAAGCCGGAA
GCACACCTTGCAATGGCGTCGAGGGATTTAACTGCTACTTCCCTCTGCAGAGCTACGGCTTTCAACCTAC
CAACGGCGTCGGATATCAACCCTATAGGGTGGTCGTGCTGAGCTTTGAACTGCTGCATGCTCCCGCCACC
GTCTGCGGACCTAAGAAGAGCACCAATCTCGTCAAAAACAAGTGCGTGAACTTCAACTTCAATGGACTGA
CCGGCACCGGCGTGCTGACCGAGAGCAATAAGAAGTTTCTGCCCTTCCAGCAGTTCGGAAGGGATATTGC
CGATACCACAGATGCTGTGAGGGACCCCCAAACCCTCGAGATTCTGGATATCACCCCTTGCAGCTTCGGA
GGAGTGTCCGTGATCACCCCCGGAACAAACACCTCCAATCAAGTGGCTGTGCTGTACCAAGACGTGAACT
GCACAGAAGTCCCCGTGGCCATCCATGCCGACCAGCTGACCCCTACATGGAGAGTGTACTCCACCGGCAG
CAATGTGTTCCAGACAAGAGCCGGATGCCTCATTGGAGCTGAACACGTCAACAACAGCTACGAGTGCGAC
ATTCCCATCGGCGCCGGCATTTGTGCCTCCTATCAGACCCAGACCAACAGCCCAAGAAGGGCTAGAAGCG
TCGCTTCCCAATCCATCATTGCCTACACCATGTCTCTGGGAGCCGAAAACTCCGTCGCCTACTCCAACAA
TAGCATCGCCATCCCCACCAATTTTACCATCTCCGTGACCACAGAGATTCTGCCCGTGTCCATGACAAAG
ACATCCGTGGACTGCACCATGTACATCTGTGGCGACAGCACCGAGTGTAGCAATCTGCTGCTGCAATATG
GCAGCTTCTGCACCCAGCTGAACAGAGCCCTCACCGGCATCGCCGTCGAACAAGACAAGAACACCCAAGA
GGTGTTCGCCCAAGTGAAGCAAATCTACAAGACCCCCCCTATCAAAGATTTCGGAGGATTCAACTTTAGC
CAGATTCTGCCCGATCCTAGCAAGCCTTCCAAGAGGAGCTTCATCGAGGATCTGCTGTTTAATAAGGTGA
CACTGGCCGACGCTGGCTTCATTAAACAGTACGGCGATTGTCTGGGCGACATCGCTGCTAGGGATCTGAT
CTGCGCTCAGAAGTTCAACGGACTGACAGTCCTCCCTCCTCTGCTGACCGACGAGATGATCGCTCAGTAT
ACCAGCGCTCTGCTGGCTGGAACCATTACCAGCGGCTGGACATTCGGCGCTGGAGCCGCCCTCCAAATTC
CCTTTGCCATGCAGATGGCCTATAGATTCAACGGCATTGGCGTCACCCAAAATGTGCTGTATGAAAATCA
GAAGCTGATTGCTAACCAATTCAATAGCGCCATTGGCAAGATCCAAGACTCTCTGAGCTCCACAGCCAGC
GCCCTCGGAAAGCTGCAAGACGTGGTGAATCAAAACGCCCAAGCTCTGAACACACTGGTGAAACAGCTCA
GCAGCAACTTTGGAGCCATCAGCAGCGTGCTCAATGATATCCTCTCTAGGCTGGACCCTCCGGAGGCCGA
AGTCCAGATCGATAGACTCATCACCGGCAGACTCCAATCTCTGCAGACATACGTCACCCAACAGCTCATT
AGAGCTGCCGAAATCAGAGCCTCCGCCAATCTGGCCGCCACCAAGATGTCCGAGTGCGTGCTGGGACAGA
GCAAGAGAGTGGACTTCTGTGGCAAGGGATACCATCTGATGAGCTTCCCCCAGAGCGCTCCCCATGGAGT
GGTCTTTCTGCATGTCACATACGTGCCCGCCCAAGAGAAGAACTTCACCACCGCTCCCGCCATTTGCCAC
GATGGAAAGGCCCACTTTCCCAGAGAAGGAGTGTTCGTGAGCAACGGCACACACTGGTTTGTCACCCAGA
GAAATTTTTACGAGCCCCAGATTATCACCACCGACAACACCTTCGTGTCCGGAAACTGCGATGTCGTGAT
TGGCATCGTGAACAACACAGTCTACGACCCTCTGCAGCCCGAACTCGACAGCTTCAAGGAAGAGCTGGAC
AAGTACTTCAAGAATCACACATCCCCCGACGTGGATCTGGGCGACATTAGCGGCATTAATGCCTCCGTCG
TCAACATTCAGAAGGAGATTGATAGACTGAATGAAGTCGCCAAGAACCTCAATGAGTCTCTGATTGATCT
```

SEQ ID NO:33 (continued)

```
GCAAGAGCTGGGCAAGTACGAGCAATACATCAAATGGCCTTGGTACATCTGGCTGGGATTCATCGCTGGA
CTCATCGCCATCGTGATGGTCACCATTATGCTGTGTTGCATGACCAGCTGCTGCAGCTGTCTGAAGGGCT
GCTGCAGCTGCGGAAGCTGCTGCAAGTTTGACGAAGACGACTCCGAGCCCGTGCTGAAGGGCGTCAAGCT
GCATTATACATAAACTAGTGCTGGAATTCGCCCTTATAGAGTGCTGGAATTCGCCCTTATAGAGTGCTGG
AATTCGCCCTTATATCTAGTAACGGCCGCCAGTGTGCTGGAATTCGCCCTTATAACTTCGTATAGCATAC
ATTATACGAAGTTATAAGGGCGAATTCTGCAGATATCCATCCTTTAAAAAACCTCCCACACCTCCCCCTG
AACCTGAAACATAAAATGAATGCAATTGTTGTTGTTAACTTGTTTATTGCAGCTTATAATGGTTACAAAT
AAAGCAATAGCATCACAAATTTCACAAATAAAGCATTTTTTTCACTGCATTCTAGTTGTGGTTTGTCCAA
ACTCATCAATGTATCTTAACAACGTGTTTATTTTTCAATTGCAGAAGAATTGCAGAAATTTCAAGTCA
TTTTTCATTCAGTAGTATAGCCCCACCACCACATAGCTTATACTAATCACCGTACCTTAATCAAACTCAC
AGAACCCTAGTATTCAACCTGCCACCTCCCTCCCAACACACAGAGTACACAGTCCTTTCTCCCCGGCTGG
CCTTAAACAGCATCATATCATGGGTAACAGACATATTCTTAGGTGTTATATTCCACACGGTCTCCTGTCG
AGCCAAACGCTCATCAGTGATGTTAATAAACTCCCCGGGCAGCTCGCTTAAGTTCATGTCGCTGTCCAGC
TGCTGAGCCACAGGCTGCTGTCCAACTTGCGGTTGCTCAACGGGCGGCGAAGGAGAAGTCCACGCCTACA
TGGGGGTAGAGTCATAATCGTGCATCAGGATAGGGCGGTGGTGCTGCAGCAGCGCGCGAATAAACTGCTG
CCGCCGCCGCTCCGTCCTGCAGGAATACAACATGGCAGTGGTCTCCTCAGCGATGATTCGCACCGCCCGC
AGCATAAGGCGCCTTGTCCTCCGGGCACAGCAGCGCACCCTGATCTCACTTAAGTCAGCACAGTAACTGC
AGCACAGTACCACAATATTGTTTAAAATCCCACAGTGCAAGGCGCTGTATCCAAAGCTCATGGCGGGGAC
CACAGAACCCACGTGGCCATCATACCACAAGCGCAGGTAGATTAAGTGGCGACCCCTCATAAACACGCTG
GACATAAACATTACCTCTTTTGGCATGTTGTAATTCACCACCTCCCGGTACCATATAAACCTCTGATTAA
ACATGGCGCCATCCACCACCATCCTAAACCAGCTGGCCAAAACCTGCCCGCCGGCTATGCACTGCAGGGA
ACCGGGACTGGAACAATGACAGTGGAGAGCCCAGGACTCGTAACCATGGATCATCATGCTCGTCATGATA
TCAATGTTGGCACAACACAGGCACACGTGCATACACTTCCTCAGGATTACAAGCTCCTCCCGCGTCAGAA
CCATATCCCAGGGAACAACCCATTCCTGAATCAGCGTAAATCCCACACTGCAGGGAAGACCTCGCACGTA
ACTCACGTTGTGCATTGTCAAAGTGTTACATTCGGGCAGCAGCGGATGATCCTCCAGTATGGTAGCGCGT
GTCTCTGTCTCAAAAGGAGGTAGGCGATCCCTACTGTACGGAGTGCGCCGAGACAACCGAGATCGTGTTG
GTCGTAGTGTCATGCCAAATGGAACGCCGGACGTAGTCATATTTCCTGAAGCAAAACCAGGTGCGGGCGT
GACAAACAGATCTGCGTCTCCGGTCTCGTCGCTTAGCTCGCTCTGTGTAGTAGTTGTAGTATATCCACTC
TCTCAAAGCATCCAGGCGCCCCCTGGCTTCGGGTTCTATGTAAACTCCTTCATGCGCCGCTGCCCTGATA
ACATCCACCACCGCAGAATAAGCCACACCCAGCCAACCTACACATTCGTTCTGCGAGTCACACACGGGAG
GAGCGGGAAGAGCTGGAAGAACCATGTTTTTTTTTTTATTCCAAAAGATTATCCAAAACCTCAAAATGA
AGATCTATTAAGTGAACGCGCTCCCCTCCGGTGGCGTGGTCAAACTCTACAGCCAAAGAACAGATAATGG
CATTTGTAAGATGTTGCACAATGGCTTCCAAAAGGCAAACTGCCCTCACGTCCAAGTGGACGTAAAGGCT
AAACCCTTCANGGTGAATCTCCTCTATAAACATTCCAGCACCTTCAACCATGCCCAAATAATTTTCATCT
CGCCACCTTATCAATATGTCTCTAAGCAAATCCCGAATATTAAGTCCGGCCATTGTAAAAATCTGCTCCA
GAGCGCCCTCCACCTTCAGCCTCAAGCAGCGAATCATGATTGCAAAAATTCAGGTTCCTCACAGACCTGT
ATAAGATTCAAAAGCGGAACATTAACAAAAATACCGCGATCCCGTAGGTCCCTTCGCAGGGCCAGCTGAA
CATAATCGTGCAGGTCTGCACGGACCAGCGCGGCCACTTCCCCGCCAGGAACCATGACAAAAGAACCCAC
ACTGATTATGACACGCATACTCGGAGCTATGCTAACCAGCGTAGCCCCGATGTAAGCTTGTTGCATGGGC
GGCGATATAAAATGCAAGGTACTGCTCAAAAAATCAGGCAAAGCCTCGCGCAAAAAAGCAAGCACATCGT
AGTCATGCTCATGCAGATAAAGGCAGGTAAGTTCCGGAACCACCACAGAAAAGACACCATTTTTCTCTC
AAACATGTCTGCGGGTTCCTGCATAAACACAAAATAAAATAACAAAAAAAAAAAAAACATTTAAACATTAG
AAGCCTGTCTTACAACAGGAAAAACAACCCTTATAAGCATAAGACGGACTACGGCCATGCCGGCGTGACC
GTAAAAAAACTGGTCACCGTGATTAAAAAGCACCACCGACAGTTCCTCGGTCATGTCCGGAGTCATAATG
TAAGACTCGGTAAACACATCAGGTTGGTTAACATCGGTCAGTGCTAAAAAGCGACCGAAATAGCCCGGGG
GAATACATACCCGCAGGCGTAGAGACAACATTACAGCCCCATAGGAGGTATAACAAAATTAATAGGAGA
GAAAAACACATAAACCCCTGAAAAACCCTCCTGCCCCTAGGCAAAATAGCACCCTCCCGCTCCAGAACAA
CATACAGCGCTTCCACAGCGGCAGCCATAACAGTCAGCCTTACCAGTAAAAAAACCTATTAAAAAACACC
ACTCGACACGGCACCAGCTCAATCAGTCACAGTGTAAAAAGGGCCAAGTACAGAGCGAGTATATATAGGA
CTAAAAAATGACGTAACGGTTAAAGTCCACAAAAACCACCCAGAAAACCGCACGCGAACCTACGCCCAGA
AACGAAAGCCAAAAAACCCACAACTTCCTCAAATCTTCACTTCCGTTTTCCCACGATACGTCACTTCCCA
TTTTAAAAAAAAACTACAATTCCCAATACATGCAAGTTACTCCGCCCTAAAACCTACGTCACCCGCCCCG
```

FIG. 58 (continued)

SEQ ID NO:33 (continued)

TTCCCACGCCCCGCGCCACGTCACAAACTCCACCCCCTCATTATCATATTGGCTTCAATCCAAAATAAGG
TATATTATTGATGATGGCGAT

FIG. 58 (continued)

SEQ ID NO:34

```
CGCCATCATCAATAATATACCTTATTTTGGATTGAAGCCAATATGATAATGAGGGGGTGGAGTTTGTGAC
GTGGCGCGGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTTACGTGGAGACTCGCCCAGGTGTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGTAAAGAGGGAGCGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGTGGTTATTATGA
ATGTGAGGTTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGGTGGTGTGTCGCCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC
GCACCAGGTGCAGACCCTGCGAGTGTGGCGGTAAACATATTAGGAACCAGCCTGTGATGCTGGATGTGAC
```

FIG. 59

SEQ ID NO:34 (continued)

```
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGGATATGAG
ATGCATCTTGGACTGTATTTTTAGGTTGGCTATGTTCCCAGCCATATCCCTCCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGGATCATGTCTACCTG
CGGGGCGATGAAGAAAACCGTTTCCGGGGTAGGGAGATCAGCTGGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGCCACTTCGTTAAGCATGTCCCTGACTTGCATGTTTTCCCT
GACCAAATCCGCCAGAAGGCGCTCGCCGCCCAGCGATAGCAGTTCTTGCAAGGAAGCAAAGTTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGGCGCCGCACGAGGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCTGGTCAGAAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGGACCCCATGGCATGGGTGGGTGAGCGCGGAGGCG
TACATGCCGCAAATGTCGTAAACGTAGAGGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
CGCGCAGCTTGTTGACCAGCTCGGCGGTGACCTGCACGTCTAGGGCGCAGTAGTCCAGGGTTTCCTTGAT
```

SEQ ID NO:34 (continued)

```
GATGTCATACTTATCCTGTCCCTTTTTTTTCCACAGCTCGCGGTTGAGGACAAACTCTTCGCGGTCTTTC
CAGTACTCTTGGATCGGAAACCCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAAGTCCGTGCGCTTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCGCGGCGCGACTACGGTACCGCGCGG
CGGGCGGTGGGCCGCGGGGTGTCCTTGGATGATGCATCTAAAAGCGGTGACGCGGGCGGGCCCCGGAG
GTAGGGGGGGCTCGGGACCCGCCGGGAGAGGGGGCAGGGGCACGTCGGCGCCGCGCGGGCAGGAGCTG
GTGCTGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCAAGGCCTCAAGGCGCTCCATGGCCTCGTAGAAGTCCACGG
CGAAGTTGAAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGGCCTCTTCTTCTTCTTCAATCTCCTCTTCCATA
AGGGCCTCCCCTTCTTCTTCTTCTGGCGGCGGTGGGGAGGGGGGACACGGCGGCGACGACGGCGCACCG
GGAGGCGGTCGACAAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAGTGCGGCGGCGG
CTGGCGGTAGAGGGCCAGCGTAGGGTGGCCGGGCTCCGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
TAAATTCGCAAGGGTATCATGGCGGACGACCGGGGTTCGAACCCCGGATCCGGCCGTCCGCCGTGATCCA
```

FIG. 59 (continued)

SEQ ID NO:34 (continued)

```
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGGTTTGACCCCGTCACTGGTCTTGTCATGCCTGGGGTATATA
CAAACGAAGCCTTCCATCCAGACATCATTTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCCGGTGGTGGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTTGGCGCGCCCGCCAGCCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GGCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
ACACCCAGTGCGCGTGCGCGGGCACTACCGCGCGCCCTGGGGCGCGCACAAACGCGGCCGCACTGGGCGC
```

SEQ ID NO:34 (continued)

```
ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAAGAAGAGATGCTCCAGGTCATCGCGCCGGAGATCTA
TGGCCCCCCGAAGAAGGAAGAGCAGGATTACAAGCCCCGAAAGCTAAAGCGGGTCAAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCGAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCCGGCGTCCGCGCCGTTCAAGGAAGTACGGCGCCGCCAGCGCGCTACTGCCCGAATATGCCCT
ACATCCTTCCATCGCGCCTACCCCGGCTATCGTGGCTACACCTACCGCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAAATAAAAGTCTGGACTCTCACGCTCGCTTGGTCCTGTAACTATTTT
GTAGAATGGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CCGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTCTGGGGTGCAATCCCTGAAGCGCCGACGATGCTTCTGATCGCGGCCGCGA
TATCGCTAGCGAAGTTCCTATTCTCTAGAAAGTATAGGAACTTCTCGAGCACGTGTTGACAATTAATCAT
CGGCATAGTATATCGGCATAGTATAATACGACAAGGTGAGGAACTAAACCATGGCCAAGTTGACCAGTGC
CGTTCCGGTGCTCACCGCGCGCGACGTCGCCGGAGCGGTCGAGTTCTGGACCGACCGGCTCGGGTTCTCC
CGGGACTTCGTGGAGGACGACTTCGCCGGTGTGGTCCGGGACGACGTGACCCTGTTCATCAGCGCGGTCC
AGGACCAGGTGGTGCCGGACAACACCCTGGCCTGGGTGTGGGTGCGCGGCCTGGACGAGCTGTACGCCGA
GTGGTCGGAGGTCGTGTCCACGAACTTCCGGGACGCCTCCGGCCGGCCATGACCGAGATCGGCGAGCAG
CCGTGGGGGCGGAGTTCGCCCTGCGCGACCCGGCCGGCAACTGCGTGCACTTCGTGGCCGAGGAGCAGG
ACTGAGAATTCGAAGTTCCTATTCTCTAGAAAGTATAGGAACTTCTCGAGCACGGGATCCTCTAGAGTCG
ATAGCTAACGTGTCGTATGTGTGTCATGTATGCGTCCATGTCGCCGCCAGAGGAGCTGCTGAGCCGCCGC
GCGCCCGCTTTCCAAGATGGCTACCCCTTCGATGATGCCGCAGTGGTCTTACATGCACATCTCGGGCCAG
GACGCCTCGGAGTACCTGAGCCCCGGCTGGTGCAGTTTGCCCGCGCCACCGAGACGTACTTCAGCCTGA
ATAACAAGTTTAGAAACCCCACGGTGGCGCCTACGCACGACGTGACCACAGACCGGTCCCAGCGTTTGAC
GCTGCGGTTCATCCCTGTGGACCGTGAGGATACTGCGTACTCGTACAAGGCGCGGTTCACCCTAGCTGTG
```

FIG. 59 (continued)

SEQ ID NO:34 (continued)

```
GGTGATAACCGTGTGCTGGACATGGCTTCCACGTACTTTGACATCCGCGGCGTGCTGGACAGGGGCCCTA
CTTTTAAGCCCTACTCTGGCACTGCCTACAACGCCCTGGCTCCCAAGGGTGCCCCAAATCCTTGCGAATG
GACATATAAAGCCGATGGTGAAACTGCCACAGAAAAAACCCACGTATTTGGGCAGGCGCCTTATTCTGGT
ATAAATATTACAAAAGATGGTATTCAACTTGGAACTGACACCGATGATCAGCCAATCTACGCAGATAAAA
CATTTCAACCTGAACCTCAAATAGGAGAATCTCAGTGGTACGAAACTGAAATTAATCATGCAGCTGGGAG
AGTCCTTAAAAGACTACCCCAATGAAACCATGTTACGGTTCATATGCAAAACCCACAAATGAAAATGGA
GGGCAAGCAAATGTGAAAACAGGAACAGGCACTACTAAAGAATATGACATAGACATGCAATTTTTCGACA
ACAGAAGTGCGGCTGCTGCTGGCCTAGCTCCAGAAGTGGTATTGTACAGTGAAGATGTAGATATAGAAAC
CCCAGACACTCATATTTCTTACATGCCCACTATTAAGGAAGGTAACTCACGAGAACTAATGGGCCAACAA
TCTATGCCCAACAGGCCTAATTACATTGCTTTTAGGGACAATTTTATTGGTCTAATGTATTACAACAGCA
CGGGTAATATGGGTGTTCTGGCGGGCCAAGCATCGCAGTTGAATGCTGTTGTAGATTTGCAAGACAGAAA
CACAGAGCTTTCATACCAGCTTTTGCTTGATTCCATTGGTGATAGAACCAGGTACTTTTCTATGTGGAAT
CAGGCTGTTGACAGCTATGATCCAGATGTTAGAATTATTGAAAATCATGGAACTGAAGATGAACTTCCAA
ATTACTGCTTTCCACTGGGAGGTGTGATTAGAACAGATACTTATCAGGGAATTAAGGCTAATGGAACTGA
TCAAACCACATGGACCAAAGATGACAGTGTCAATGATGCTAATGAGGAAATAAGAGTTGGAAATAATTTT
GCCATGGAAATCAATCTAAATGCCAACCTGTGGAGAAATTTCCTGTACTCCAACATAGCGCTGTATTTGC
CCGACAAGCTAAAGTACAGTCCTTCCAACGTAAAAATTTCTGATAACCCAAACACCTACGACTACATGAA
CAAGCGAGTGGTGGCTCCCGGGTTAGTGGACTGCTACATTAACCTTGGAGCACGCTGGTCCCTTGACTAT
ATGGACAACGTCAACCCATTTAACCACCACCGCAATGCTGGCCTGCGCTACCGCTCAATGTTGCTGGGCA
ATGGTCGCTATGTGCCCTTCCACATCCAGGTGCCTCAGAAGTTCTTTGCCATTAAAAACCTCCTTCTCCT
GCCGGGCTCATACACCTACGAGTGGAACTTCAGGAAGGATGTTAACATGGTTCTGCAGAGCTCTCTGGGA
AACGACCTTAGAGTTGACGGGGCTAGCATTAAGTTTGACAGCATTTGTCTTTACGCCACCTTCTTCCCCA
TGGCCCACAACACGGCCTCCACGCTGGAAGCCATGCTCAGAAATGACACCAACGACCAGTCCTTTAATGA
CTACCTTTCCGCCGCCAACATGCTATATCCCATACCCGCCAACGCCACCAACGTGCCCATCTCCATCCCA
TCGCGCAACTGGGCAGCATTTCGCGGTTGGGCCTTCACACGCTTGAAGACAAAGGAAACCCCTTCCCTGG
GATCAGGCTACGACCCTTACTACACCTACTCTGGCTCCATACCATACCTTGACGGAACCTTCTATCTTAA
TCACACCTTTAAGAAGGTGGCCATTACTTTTGACTCTTCTGTTAGCTGGCCGGGCAACGACCGCCTGCTT
ACTCCCAATGAGTTTGAGATTAAGCGCTCAGTTGACGGGGAGGGCTATAACGTAGCTCAGTGCAACATGA
CAAAGGACTGGTTCCTAGTGCAGATGTTGGCCAACTACAATATTGGCTACCAGGGCTTCTACATTCCAGA
AAGCTACAAAGACCGCATGTACTCGTTCTTCAGAAACTTCCAGCCCATGAGCCGGCAAGTGGTGGACGAT
ACTAAATACAAAGATTATCAGCAGGTTGGAATTATCCACCAGCATAACAACTCAGGCTTCGTAGGCTACC
TCGCTCCCACCATGCGCGAGGGACAAGCTTACCCCGCTAATGTTCCCTACCCACTAATAGGCAAAACCGC
GGTTGATAGTATTACCCAGAAAAAGTTTCTTTGCGACCGCACCCTGTGGCGCATCCCCTTCTCCAGTAAC
TTTATGTCCATGGGTGCGCTCACAGACCTGGGCCAAAACCTTCTCTACGCAAACTCCGCCCACGCGCTAG
ACATGACCTTTGAGGTGGATCCCATGGACGAGCCCACCCTTCTTTATGTTTTGTTTGAAGTCTTTGACGT
GGTCCGTGTGCACCAGCCGCACCGCGGCGTCATCGAGACCGTGTACCTGCGCACGCCCTTCTCGGCCGGC
AACGCCACAACATAAAGAAGCAAGCAACATCAACAACAGCTGCCGCCATGGGCTCCAGTGAGCAGGAACT
GAAAGCCATTGTCAAAGATCTTGGTTGTGGGCCATATTTTTGGGCACCTATGACAAGCGCTTCCCAGGC
TTTGTTTCCCCACACAAGCTCGCCTGCGCCATAGTTAACACGGCCGGTCGCGAGACTGGGGCGTACACT
GGATGGCCTTTGCCTGGAACCCGCGCTCAAAAACATGCTACCTCTTTGAGCCCTTTGGCTTTTCTGACCA
ACGTCTCAAGCAGGTTTACCAGTTTGAGTACGAGTCACTCCTGCGCCGTAGCGCCATTGCCTCTTCCCCC
GACCGCTGTATAACGCTGGAAAAGTCCACCCAAAGCGTGCAGGGGCCCAACTCGGCCGCCTGTGGCCTAT
TCTGCTGCATGTTTCTCCACGCCTTTGCCAACTGGCCCCAAACTCCCATGGATCACAACCCCACCATGAA
CCTTATTACCGGGGTACCCAACTCCATGCTTAACAGTCCCAGGTACAGCCCACCCTGCGCCGCAACCAG
GAACAGCTCTACAGCTTCCTGGAGCGCCACTCGCCCTACTTCCGCAGCCACAGTGCGCAAATTAGGAGCG
CCACTTCTTTTGTCACTTGAAAAACATGTAAAAATAATGTACTAGGAGACACTTTCAATAAAGGCAAAT
GTTTTTATTTGTACACTCTCGGGTGATTATTTACCCCCACCCTTGCCGTCTGCGCCGTTTAAAAATCAAA
GGGGTTCTGCCGCGCATCGCTATGCGCCACTGGCAGGGACACGTTGCGATACTGGTGTTTAGTGCTCCAC
TTAAACTCAGGCACAACCATCCGCGGCAGCTCGGTGAAGTTTTCACTCCACAGGCTGCGCACCATCACCA
ACGCGTTTAGCAGGTCGGGCGCCGATATCTTGAAGTCGCAGTTGGGGCCTCCGCCCTGCGCGCGCGAGTT
GCGATACACAGGGTTACAGCACTGGAACACTATCAGCGCCGGGTGGTGCACGCTGGCCAGCACGCTCTTG
TCGGAGATCANATCCGCGTCCAGGTCCTCCGCGTTGCTCAGGGCGAACGGAGTCAACTTTGGTAGCTGCC
```

SEQ ID NO:34 (continued)

```
TTCCCAAAAAGGGTGCATGCCCAGGCTTTGAGTTGCACTCGCACCGTAGTGGCATCAGAAGGTGACCGTG
CCCAGTCTGGGCGTTAGGATACAGCGCCTGCATGAAAGCCTTGATCTGCTTAAAAGCCACCTGAGCCTTT
GCGCCTTCAGAGAAGAACATGCCGCAAGACTTGCCGGAAAACTGATTGGCCGGACAGGCCGCGTCATGCA
CGCAGCACCTTGCGTCGGTGTTGGAGATCTGCACCACATTTCGGCCCCACCGGTTCTTCACGATCTTGGC
CTTGCTAGACTGCTCCTTCAGCGCGCGCTGCCCGTTTTCGCTCGTCACATCCATTTCAATCACGTGCTCC
TTATTTATCATAATGCTCCCGTGTAGACACTTAAGCTCGCCTTCGATCTCAGCGCAGCGGTGCAGCCACA
ACGCGCAGCCCGTGGGCTCGTGGTGCTTGTAGGTTACCTCTGCAAACGACTGCAGGTACGCCTGCAGGAA
TCGCCCCATCATCGTCACAAGGTCTTGTTGCTGGTGAAGGTCAGCTGCAACCCGCGGTGCTCCTCGTTT
AGCCAGGTCTTGCATACGGCCGCCAGAGCTTCCACTTGGTCAGGCAGTAGCTTGAAGTTTGCCTTTAGAT
CGTTATCCACGTGGTACTTGTCCATCAACGCGCGCGCAGCCTCCATGCCCTTCTCCCACGCAGACACGAT
CGGCAGGCTCAGCGGGTTTATCACCGTGCTTTCACTTTCCGCTTCACTGGACTCTTCCTTTTCCTCTTGC
ATCCGCATACCCCGCGCCACTGGGTCGTCTTCATTCAGCCGCCGCACCGTGCGCTTACCTCCCTTGCCGT
GCTTGATTAGCACCGGTGGGTTGCTGAAACCCACCATTTGTAGCGCCACATCTTCTCTTTCTTCCTCGCT
GTCCACGATCACCTCTGGGGATGGCGGGCGCTCGGGCTTGGGAGAGGGGCGCTTCTTTTCTTTTTGGAC
GCAATGGCCAAATCCGCCGTCGAGGTCGATGGCCGCGGGCTGGGTGTGCGCGGCACCAGCGCATCTTGTG
ACGAGTCTTCTTCGTCCTCGGACTCGAGACGCCGCCTCAGCCGCTTTTTGGGGCGCGCGGGGAGGCGG
CGGCGACGGCGACGGGACGAGACGTCCTCCATGGTTGGTGGACGTCGCGCCGCACCGCGTCCGCGCTCG
GGGGTGGTTTCGCGCTGCTCCTCTTCCCGACTGGCCATTTCCTTCTCCTATAGGCAGAAAAAGATCATGG
AGTCAGTCGAGAAGGAGGACAGCCTAACCGCCCCCTTTGAGTTCGCCACCACCGCCTCCACCGATGCCGC
CAACGCGCCTACCACCTTCCCCGTCGAGGCACCCCCGCTTGAGGAGGAGGAAGTGATTATCGAGCAGGAC
CCAGGTTTTGTAAGCGAAGACGACGAAGATCGCTCAGTACCAACAGAGGATAAAAAGCAAGACCAGGACG
ACGCAGAGGCAAACGAGGAACAAGTCGGGCGGGGGGACCAAAGGCATGGCGACTACCTAGATGTGGGAGA
CGACGTGCTGTTGAAGCATCTGCAGCGCCAGTGCGCCATTATCTGCGACGCGTTGCAAGAGCGCAGCGAT
GTGCCCCTCGCCATAGCGGATGTCAGCCTTGCCTACGAACGCCACCTGTTCTCACCGCGCGTACCCCCA
AACGCCAAGAAAACGGCACATGCGAGCCCAACCCGCGCCTCAACTTCTACCCCGTATTTGCCGTGCCAGA
GGTGCTTGCCACCTATCACATCTTTTTCCAAAACTGCAAGATACCCCTATCCTGCCGTGCCAACCGCAGC
CGAGCGGACAAGCAGCTGGCCTTGCGGCAGGGCGCTGTCATACCTGATATCGCCTCGCTCGACGAAGTGC
CAAAAATCTTTGAGGGTCTTGGACGCGACGAGAAGCGCGCGGCAAACGCTCTGCAACAAGAAAACAGCGA
AAATGAAAGTCACTGTGGAGTGCTGGTGGAACTTGAGGGTGACAACGCGCGCCTAGCCGTGCTGAAACGC
AGCATCGAGGTCACCCACTTTGCCTACCCGGCACTTAACCTACCCCCCAAGGTTATGAGCACAGTCATGA
GCGAGCTGATCGTGCGCCGTGCACGACCCCTGGAGAGGGATGCAAACTTGCAAGAACAAACCGAGGAGGG
CCTACCCGCAGTTGGCGATGAGCAGCTGGCGCGCTGGCTTGAGACGCGCGAGCCTGCCGACTTGGAGGAG
CGACGCAAGCTAATGATGGCCGCAGTGCTTGTTACCGTGGAGCTTGAGTGCATGCAGCGGTTCTTTGCTG
ACCCGGAGATGCAGCGCAAGCTAGAGGAAACGTTGCACTACACCTTTCGCCAGGGCTACGTGCGCCAGGC
CTGCAAAATTTCCAACGTGGAGCTCTGCAACCTGGTCTCCTACCTTGGAATTTTGCACGAAAACCGCCTT
GGGCAAAACGTGCTTCATTCCACGCTCAAGGGCGAGGCGCGCCGCGACTACGTCCGCGACTGCGTTTACT
TATTTCTGTGCTACACCTGGCAAACGGCCATGGGCGTGTGGCAGCAGTGCCTGGAGGAGCGCAACCTGAA
GGAGCTGCAGAAGCTGCTAAAGCAAAACTTGAAGGACCTATGGACGGCCTTCAACGAGCGCTCCGTGGCC
GCGCACCTGGCGGACATTATCTTCCCCGAACGCCTGCTTAAAACCCTGCAACAGGGTCTGCCAGACTTCA
CCAGTCAAAGCATGTTGCAAAACTTTAGGAACTTTATCCTAGAGCGTTCAGGAATTCTGCCCGCCACCTG
CTGTGCGCTTCCTAGCGACTTTGTGCCCATTAAGTACCGTGAATGCCCTCCGCCGCTTTGGGGTCACTGC
TACCTTNTGCAGCTAGCCAACTACCTTGCCTACCACTCCGACATCATGGAAGACGTGAGCGGTGACGGCC
TACTGGAGTGTCACTGTCGCTGCAACCTATGCACCCCGCACCGCTCCCTGGTCTGCAATTCACAACTGCT
TAGCGAAAGTCAAATTATCGGTACCTTTGAGCTGCAGGGTCCCTCGCCTGACGAAAAGTCCGCGGCTCCG
GGGTTGAAACTCACTCCGGGGCTGTGGACGTCGGCTTACCTTCGCAAATTTGTACCTGAGGACTACCACG
CCCACGAGATTAGGTTCTACGAAGACCAATCCCGCCCGCCAAATGCGGAGCTTACCGCCTGCGTCATTAC
CCAGGGCCACATCCTTGGCCAATTGCAAGCCATTAACAAAGCCCGCCAAGAGTTTCTGCTACGAAAGGGA
CGGGGGGTTTACTTGGACCCCAGTCCGGCGAGGAGCTCAACCCAATCCCCCGCCGCCGCAGCCCTATC
AGCAGCCGCGGGCCCTTGCTTCCCAGGATGGCACCCAAAAAGAAGCTGCAGCTGCCGCCGCCGCCACCCA
CGGACGAGGAGGAATACTGGGACAGTCAGGCAGAGGAGGTTTTGGACGAGGAGGAGGAGATGATGGAAGA
CTGGGACAGCCTAGACGAGGAAGCTTCCGAGGCCGAAGAGGTGTCAGACGAAACACCGTCACCCTCGGTC
GCATTCCCCTCGCCGGCGCCCCAGAAATCGGCAACCGTTCCCAGCATTGCTACAACCTCCGCTCCTCAGG
```

SEQ ID NO:34 (continued)

```
CGCCGCCGGCACTGCCCGTTCGCCGACCCAACCGTAGATGGGACACCACTGGAACCAGGGCCGGTAAGTC
TAAGCAGCCGCCGCCGTTAGCCCAAGAGCAACAACAGCGCCAAGGCTACCGCTCGTGGCGCGTGCACAAG
AACGCCATAGTTGCTTGCTTGCAAGACTGTGGGGGCAACATCTCCTTCGCCCGCCGCTTTCTTCTCTACC
ATCACGGCGTGGCCTTCCCCCGTAACATCCTGCATTACTACCGTCATCTCTACAGCCCCTACTGCACCGG
CGGCAGCGGCAGCAACAGCAGCGGCCACGCAGAAGCAAAGGCGACCGGATAGCAAGACTCTGACAAAGCC
CAAGAAATCCACAGCGGCGGCAGCAGCAGGAGGAGGAGCACTGCGTCTGGCGCCAACGAACCCGTATCG
ACCCGCGAGCTTAGAAACAGGATTTTTCCCACTCTGTATGCTATATTTCAACAGAGCAGGGGCCAAGAAC
AAGAGCTGAAAATAAAAAACAGGTCTCTGCGCTCCCTCACCCGCAGCTGCCTGTATCACAAAAGCGAAGA
TCAGCTTCGGCGCACGCTGGAAGACGCGGAGGCTCTCTTCAGCAAATACTGCGCGCTGACTCTTAAGGAC
TAGTTTCGCGCCCTTTCTCAAATTTAAGCGCGAAAACTACGTCATCTCCAGCGGCCACACCCGGCGCCAG
CACCTGTCGTCAGCGCCATTATGAGCAAGGAAATTCCCACGCCCTACATGTGGAGTTACCAGCCACAAAT
GGGACTTGCGGCTGGAGCTGCCCAAGACTACTCAACCCGAATAAACTACATGAGCGCGGGACCCCACATG
ATATCCCGGGTCAACGGAATCCGCGCCCACCGAAACCGAATTCTCCTCGAACAGGCGGCTATTACCACCA
CACCTCGTAATAACCTTAATCCCCGTAGTTGGCCCGCTGCCCTGGTGTACCAGGAAAGTCCCGCTCCCAC
CACTGTGGTACTTCCCAGAGACGCCCAGGCCGAAGTTCAGATGACTAACTCAGGGGCGCAGCTTGCGGGC
GGCTTTCGTCACAGGGTGCGGTCGCCCGGGCAGGGTATAACTCACCTGAAAATCAGAGGGCGAGGTATTC
AGCTCAACGACGAGTCGGTGAGCTCCTCTCTTGGTCTCCGTCCGGACGGGACATTTCAGATCGGCGGCGC
TGGCCGCTCTTCATTTACGCCCGTCAGGCGATCCTAACTCTGCAGACCTCGTCCTCGGAGCCGCGCTCC
GGAGGCATTGGAACTCTACAATTTATTGAGGAGTTCGTGCCTTCGGTTTACTTCAACCCCTTTTCTGGAC
CTCCCGGCCACTACCCGGACCAGTTTATTCCCAACTTTGACGCGGTAAAAGACTCGGCGGACGGCTACGA
CTGACAGATCTGAGCTCGCGGCCGCGATATCGCTAGCGAAGTTCCTATTCTCTAGAAAGTATAGGAACTT
CGATCCTCTAGAGTCGACCTGCAGGCATGCAAGCTTGGCACTGCAATAAATTACTTACTTAAAATCAGTC
AGCAAATCTTTGTCCAGCTTATTCAGCATCACCTCCTTTCCCTCCTCCCAACTCTGGTATTTCAGCAGCC
TTTTAGCTGCGAACTTTCTCCAAAGTCTAAATGGGATGTCAAATTCCTCATGTTCTTGTCCCTCCGCACC
CACTATCTTCATATTGTTGCAGATGAAACGCGCCAGACCGTCTGAAGACACCTTCAACCCTGTGTACCCA
TATGACACGGAAACCGGCCCTCCAACTGTGCCTTTCCTTACCCCTCCCTTTGTGTCGCCAAATGGGTTCC
AAGAAAGTCCCCCCGGAGTGCTTTCTTTGCGTCTTTCAGAACCTTTGGTTACCTCACACGGCATGCTTGC
GCTAAAAATGGGCAGCGGCCTGTCCCTGGATCAGGCAGGCAACCTTACATCAAATACAATCACTGTTTCT
CAACCGCTAAAAAAACAAAGTCCAATATAACTTTGGAAACATCCGCGCCCCTTACAGTCAGCTCAGGCG
CCCTAACCATGGCCACAACTTCGCCTTTGGTGGTCTCTGACAACACTCTTACCATGCAATCACAAGCACC
GCTAACCGTGCAAGACTCAAAACTTAGCATTGCTACCAAAGAGCCACTTACAGTGTTAGATGGAAAACTG
GCCCTGCAGACATCAGCCCCCTCTCTGCCACTGATAACAACGCCCTCACTATCACTGCCTCACCTCCTC
TTACTACTGCAAATGGTAGTCTGGCTGTTACCATGGAAAACCCACTTTACAACAACAATGGAAAACTTGG
GCTCAAAATTGGCGGTCCTTTGCAAGTGGCCACCGACTCACATGCACTAACACTAGGTACTGGTCAGGGG
GTTGCAGTTCATAACAATTTGCTACATACAAAAGTTACAGGCGCAATAGGGTTTGATACATCTGGCAACA
TGGAACTTAAAACTGGAGATGGCCTCTATGTGGATAGCGCCGGTCCTAACCAAAAACTACATATTAATCT
AAATACCACAAAAGGCCTTGCTTTTGACAACACCGCAATAACAATTAACGCTGGAAAAGGGTTGGAATTT
GAAACAGACTCCTCAAACGGAAATCCCATAAAAACAAAAATTGGATCAGGCATACAATATAATACCAATG
GAGCTATGGTTGCAAAACTTGGAACAGGCCTCAGTTTTGACAGCTCCGGAGCCATAACAATGGGCAGCAT
AAACAATGACAGACTTACTCTTTGGACAACACCAGACCCATCCCCAAATTGCAGAATTGCTTCAGATAAA
GACTGCAAGCTAACTCTGGCGCTAACAAAATGTGGCAGTCAAATTTTGGGCACTGTTTCAGCTTTGGCAG
TATCAGGTAATATGGCCTCCATCAATGGAACTCTAAGCAGTGTAAACTTGGTTCTTAGATTTGATGACAA
CGGAGTGCTTATGTCAAATTCATCACTGGACAAACAGTATTGGAACTTTAGAAACGGGGACTCCACTAAC
GGTCAACCATACACTTATGCTGTTGGGTTTATGCCAAACCTAAAAGCTTACCCAAAAACTCAAAGTAAAA
CTGCAAAAAGTAATATTGTTAGCCAGGTGTATCTTAATGGTGACAAGTCTAAACCATTGCATTTACTAT
TACGCTAAATGGAACAGATGAAACCAACCAAGTAAGCAAATACTCAATATCATTCAGTTGGTCCTGGAAC
AGTGGACAATACACTAATGACAAATTTGCCACCAATTCCTATACCTTCTCCTACATTGCCCAGGAATAAA
GAATCGTGAACCTGTTGCATGTTATGTTTCAACGTGTTTATTTTTCAATTCGTATTAGTCATCGCTATTA
CCATGGTGATGCGGTTTTGGCAGTACATCAATGGGCGTGGATAGCGGTTTGACTCACGGGGATTTCCAAG
TCTCCACCCCATTGACGTCAATGGGAGTTTGTTTTGGCACCAAAATCAACGGGACTTTCCAAAATGTCGT
AACAACTCCGCCCCATTGACGCAAATGGGCGGTAGGCGTGTACGGTGGGAGGTCTATATAAGCAGAGCTG
GTTTAGTGAACCGTCAGATCCGCTAGAGATCCACCATGTTTGTCTTTCTCGTGCTGCTGCCCCTCGTGAG
```

FIG. 59 (continued)

SEQ ID NO:34 (continued)

```
CAGCCAGTGCGTCAATCTGACAACAAGGACCCAGCTGCCCCCGCCTACACCAACTCCTTCACAAGAGGC
GTGTATTACCCCGATAAGGTCTTCAGATCCAGCGTCCTCCACAGCACCCAAGATTTGTTTCTGCCTTTCT
TCAGCAACGTGACATGGTTCCACGCCATTCATGTCAGCGGCACAAACGGCACAAAGAGGTTTGACAACCC
CGTGCTCCCCTTCAACGACGGCGTGTACTTCGCCAGCACAGAGAAATCCAATATCATTAGGGGCTGGATC
TTCGGCACAACACTGGATTCCAAGACCCAGTCTCTGCTCATTGTGAATAACGCCACCAACGTGGTGATTA
AGGTCTGTGAGTTTCAGTTCTGCAACGACCCCTTTCTGGGAGTCTACTACCACAAGAATAATAAGAGCTG
GATGGAGTCCGAGTTTAGGGTGTACAGCTCCGCCAACAACTGTACCTTCGAATACGTGTCCCAGCCTTTC
CTCATGGATCTGGAGGGCAAGCAAGGCAATTTCAAAAATCTGAGAGAGTTCGTGTTCAAAAACATTGATG
GATACTTCAAAATCTACAGCAAGCATACCCCCATTAATCTGGTGAGGGATCTGCCCCAAGGATTCTCCGC
TCTGGAACCTCTGGTGGATCTGCCCATTGGCATTAACATCACAAGATTCCAGACCCTCCTCGCCCTCCAT
AGATCCTATCTGACCCCCGGCGACTCCTCCAGCGGATGGACAGCCGGAGCTGCCGCCTACACGTGGGCT
ATCTGCAGCCAAGAACCTTTCTGCTGAAGTACAACGAGAACGGCACCATCACAGACGCTGTCGATTGCGC
TCTCGACCCTCTGAGCGAGACCAAATGCACACTGAAGAGCTTCACCGTGGAAAAGGGCATCTATCAGACC
AGCAACTTCAGAGTGCAGCCTACCGAGAGCATTGTGAGGTTTCCCAACATCACCAATCTGTGTCCTTTCG
GCGAGGTCTTTAATGCCACAAGGTTCGCTTCCGTGTATGCTTGGAATAGGAAGAGGATCAGCAATTGCGT
CGCCGACTATTCCGTCCTCTATAACAGCGCCTCCTTCTCCACCTTCAAATGTTATGGCGTGTCCCCCACC
AAGCTCAACGACCTCTGCTTCACCAATGTGTACGCTGACTCCTTCGTCATTAGGGGCGACGAGGTGAGGC
AAATTGCCCCCGGCCAGACCGGCAAGATTGCTGATTACAACTACAAACTGCCCGACGATTTTACCGGCTG
CGTGATCGCTTGGAACTCCAACAATCTGGACTCCAAAGTGGGCGGAAACTACAATTACCTCTACAGACTC
TTTAGAAAAAGCAATCTGAAGCCCTTCGAGAGAGACATCTCCACCGAAATCTACCAAGCCGGAAGCACAC
CTTGCAATGGCGTCGAGGGATTTAACTGCTACTTCCCTCTGCAGAGCTACGGCTTTCAACCTACCAACGG
CGTCGGATATCAACCCTATAGGGTGGTCGTGCTGAGCTTTGAACTGCTGCATGCTCCCGCCACCGTCTGC
GGACCTAAGAAGAGCACCAATCTCGTCAAAAACAAGTGCGTGAACTTCAACTTCAATGGACTGACCGGCA
CCGGCGTGCTGACCGAGAGCAATAAGAAGTTTCTGCCCTTCCAGCAGTTCGGAAGGGATATTGCCGATAC
CACAGATGCTGTGAGGGACCCCCAAACCCTCGAGATTCTGGATATCACCCCTTGCAGCTTCGGAGGAGTG
TCCGTGATCACCCCCGGAACAAACACCTCCAATCAAGTGGCTGTGCTGTACCAAGACGTGAACTGCACAG
AAGTCCCCGTGGCCATCCATGCCGACCAGCTGACCCCTACATGGAGAGTGTACTCCACCGGCAGCAATGT
GTTCCAGACAAGAGCCGGATGCCTCATTGGAGCTGAACACGTCAACAACAGCTACGAGTGCGACATTCCC
ATCGGCGCCGGCATTTGTGCCTCCTATCAGACCCAGACCAACAGCCCAAGAAGGGCTAGAAGCGTCGCTT
CCCAATCCATCATTGCCTACACCATGTCTCTGGGAGCCGAAAACTCCGTCGCCTACTCCAACAATAGCAT
CGCCATCCCCACCAATTTTACCATCTCCGTGACCACAGAGATTCTGCCCGTGTCCATGACAAAGACATCC
GTGGACTGCACCATGTACATCTGTGGCGACAGCACCGAGTGTAGCAATCTGCTGCTGCAATATGGCAGCT
TCTGCACCCAGCTGAACAGAGCCCTCACCGGCATCGCCGTCGAACAAGACAAGAACACCCAAGAGGTGTT
CGCCCAAGTGAAGCAAATCTACAAGACCCCCCCTATCAAAGATTTCGGAGGATTCAACTTTAGCCAGATT
CTGCCCGATCCTAGCAAGCCTTCCAAGAGGAGCTTCATCGAGGATCTGCTGTTTAATAAGGTGACACTGG
CCGACGCTGGCTTCATTAAACAGTACGGCGATTGTCTGGGCGACATCGCTGCTAGGGATCTGATCTGCGC
TCAGAAGTTCAACGGACTGACAGTCCTCCCTCCTCTGCTGACCGACGAGATGATCGCTCAGTATACCAGC
GCTCTGCTGGCTGGAACCATTACCAGCGGCTGGACATTCGGCGCTGGAGCCGCCCTCCAAATTCCCTTTG
CCATGCAGATGGCCTATAGATTCAACGGCATTGGCGTCACCCAAAATGTGCTGTATGAAAATCAGAAGCT
GATTGCTAACCAATTCAATAGCGCCATTGGCAAGATCCAAGACTCTCTGAGCTCCACAGCCAGCGCCCTC
GGAAAGCTGCAAGACGTGGTGAATCAAAACGCCCAAGCTCTGAACACACTGGTGAAACAGCTCAGCAGCA
ACTTTGGAGCCATCAGCAGCGTGCTCAATGATATCCTCTCTAGGCTGGACAAAGTGGAGGCCGAAGTCCA
GATCGATAGACTCATCACCGGCAGACTCCAATCTCTGCAGACATACGTCACCCAACAGCTCATTAGAGCT
GCCGAAATCAGAGCCTCCGCCAATCTGGCCGCCACCAAGATGTCCGAGTGCGTGCTGGGACAGAGCAAGA
GAGTGGACTTCTGTGGCAAGGGATACCATCTGATGAGCTTCCCCAGAGCGCTCCCCATGGAGTGGTCTT
TCTGCATGTCACATACGTGCCCGCCCAAGAGAAGAACTTCACCACCGCTCCCGCCATTTGCCACGATGGA
AAGGCCCACTTTCCCAGAGAAGGAGTGTTCGTGAGCAACGGCACACACTGGTTTGTCACCCAGAGAAATT
TTTACGAGCCCCAGATTATCACCACCGACAACACCTTCGTGTCCGGAAACTGCGATGTCGTGATTGGCAT
CGTGAACAACACAGTCTACGACCCTCTGCAGCCCGAACTCGACAGCTTCAAGGAAGAGCTGGACAAGTAC
TTCAAGAATCACACATCCCCCGACGTGGATCTGGGCGACATTAGCGGCATTAATGCCTCCGTCGTCAACA
TTCAGAAGGAGATTGATAGACTGAATGAAGTCGCCAAGAACCTCAATGAGTCTCTGATTGATCTGCAAGA
GCTGGGCAAGTACGAGCAATACATCAAATGGCCTTGGTACATCTGGCTGGGATTCATCGCTGGACTCATC
```

SEQ ID NO:34 (continued)

```
GCCATCGTGATGGTCACCATTATGCTGTGTTGCATGACCAGCTGCTGCAGCTGTCTGAAGGGCTGCTGCA
GCTGCGGAAGCTGCTGCAAGTTTGACGAAGACGACTCCGAGCCCGTGCTGAAGGGCGTCAAGCTGCATTA
TACATAAACTAGTGCTGGAATTCGCCCTTATAGAGTGCTGGAATTCGCCCTTATAGAGTGCTGGAATTCG
CCCTTATATCTAGTAACGGCCGCCAGTGTGCTGGAATTCGCCCTTATAACTTCGTATAGCATACATTATA
CGAAGTTATAAGGGCGAATTCTGCAGATATCCATCCTTTAAAAAACCTCCCACACCTCCCCCTGAACCTG
AAACATAAATGAATGCAATTGTTGTTGTTAACTTGTTTATTGCAGCTTATAATGGTTACAAATAAAGCA
ATAGCATCACAAATTTCACAAATAAAGCATTTTTTTCACTGCATTCTAGTTGTGGTTTGTCCAAACTCAT
CAATGTATCTTAACAACGTGTTTATTTTCAATTGCAGAAAGAATTGCAGAAAATTTCAAGTCATTTTTC
ATTCAGTAGTATAGCCCCACCACCACATAGCTTATACTAATCACCGTACCTTAATCAAACTCACAGAACC
CTAGTATTCAACCTGCCACCTCCCTCCCAACACACAGAGTACACAGTCCTTTCTCCCGGCTGGCCTTAA
ACAGCATCATATCATGGGTAACAGACATATTCTTAGGTGTTATATTCCACACGGTCTCCTGTCGAGCCAA
ACGCTCATCAGTGATGTTAATAAACTCCCCGGGCAGCTCGCTTAAGTTCATGTCGCTGTCCAGCTGCTGA
GCCACAGGCTGCTGTCCAACTTGCGGTTGCTCAACGGGCGGCGAAGGAGAAGTCCACGCCTACATGGGGG
TAGAGTCATAATCGTGCATCAGGATAGGGCGGTGGTGCTGCAGCAGCGCGCGAATAAACTGCTGCCGCCG
CCGCTCCGTCCTGCAGGAATACAACATGGCAGTGGTCTCCTCAGCGATGATTCGCACCGCCCGCAGCATA
AGGCGCCTTGTCCTCCGGGCACAGCAGCGCACCCTGATCTCACTTAAGTCAGCACAGTAACTGCAGCACA
GTACCACAATATTGTTTAAAATCCCACAGTGCAAGGCGCTGTATCCAAAGCTCATGGCGGGGACCACAGA
ACCCACGTGGCCATCATACCACAAGCGCAGGTAGATTAAGTGGCGACCCCTCATAAACACGCTGGACATA
AACATTACCTCTTTTGGCATGTTGTAATTCACCACCTCCCGGTACCATATAAACCTCTGATTAAACATGG
CGCCATCCACCACCATCCTAAACCAGCTGGCCAAAACCTGCCCGCCGGCTATGCACTGCAGGGAACCGGG
ACTGGAACAATGACAGTGGAGAGCCCAGGACTCGTAACCATGGATCATCATGCTCGTCATGATATCAATG
TTGGCACAACACAGGCACACGTGCATACACTTCCTCAGGATTACAAGCTCCTCCCGCGTCAGAACCATAT
CCCAGGGAACAACCCATTCCTGAATCAGCGTAAATCCCACACTGCAGGGAAGACCTCGCACGTAACTCAC
GTTGTGCATTGTCAAAGTGTTACATTCGGGCAGCAGCGGATGATCCTCCAGTATGGTAGCGCGTGTCTCT
GTCTCAAAAGGAGGTAGGCGATCCCTACTGTACGGAGTGCGCCGAGACAACCGAGATCGTGTTGGTCGTA
GTGTCATGCCAAATGGAACGCCGGACGTAGTCATATTTCCTGAAGCAAAACCAGGTGCGGGCGTGACAAA
CAGATCTGCGTCTCCGGTCTCGTCGCTTAGCTCGCTCTGTGTAGTAGTTGTAGTATATCCACTCTCTCAA
AGCATCCAGGCGCCCCCTGGCTTCGGGTTCTATGTAAACTCCTTCATGCGCCGCTGCCCTGATAACATCC
ACCACCGCAGAATAAGCCACACCCAGCCAACCTACACATTCGTTCTGCGAGTCACACACGGGAGGAGCGG
GAAGAGCTGGAAGAACCATGTTTTTTTTTTTATTCCAAAAGATTATCCAAAACCTCAAAATGAAGATCT
ATTAAGTGAACGCGCTCCCCTCCGGTGGCGTGGTCAAACTCTACAGCCAAAGAACAGATAATGGCATTTG
TAAGATGTTGCACAATGGCTTCCAAAAGGCAAACTGCCCTCACGTCCAAGTGGACGTAAAGGCTAAACCC
TTCANGGTGAATCTCCTCTATAAACATTCCAGCACCTTCAACCATGCCCAAATAATTTTCATCTCGCCAC
CTTATCAATATGTCTCTAAGCAAATCCCGAATATTAAGTCCGGCCATTGTAAAAATCTGCTCCAGAGCGC
CCTCCACCTTCAGCCTCAAGCAGCGAATCATGATTGCAAAAATTCAGGTTCCTCACAGACCTGTATAAGA
TTCAAAAGCGGAACATTAACAAAAATACCGCGATCCCGTAGGTCCCTTCGCAGGGCCAGCTGAACATAAT
CGTGCAGGTCTGCACGGACCAGCGCGGCCACTTCCCCGCCAGGAACCATGACAAAAGAACCCACACTGAT
TATGACACGCATACTCGGAGCTATGCTAACCAGCGTAGCCCCGATGTAAGCTTGTTGCATGGGCGGCGAT
ATAAAATGCAAGGTACTGCTCAAAAAATCAGGCAAAGCCTCGCGCAAAAAGCAAGCACATCGTAGTCAT
GCTCATGCAGATAAAGGCAGGTAAGTTCCGGAACCACCACAGAAAAGACACCATTTTTCTCTCAAACAT
GTCTGCGGGTTCCTGCATAAACACAAAATAAAATAACAAAAAAAAAAAAACATTTAAACATTAGAAGCCT
GTCTTACAACAGGAAAAACAACCCTTATAAGCATAAGACGGACTACGGCCATGCCGGCGTGACCGTAAAA
AAACTGGTCACCGTGATTAAAAAGCACCACCGACAGTTCCTCGGTCATGTCCGGAGTCATAATGTAAGAC
TCGGTAAACACATCAGGTTGGTTAACATCGGTCAGTGCTAAAAGCGACCGAAATAGCCCGGGGAATAC
ATACCCGCAGGCGTAGAGACAACATTACAGCCCCATAGGAGGTATAACAAAATTAATAGGAGAGAAAA
CACATAAACCCCTGAAAAACCCTCCTGCCCCTAGGCAAAATAGCACCCTCCCGCTCCAGAACAACATACA
GCGCTTCCACAGCGGCAGCCATAACAGTCAGCCTTACCAGTAAAAAAACCTATTAAAAAACACCACTCGA
CACGGCACCAGCTCAATCAGTCACAGTGTAAAAAGGGCCAAGTACAGAGCGAGTATATATAGGACTAAAA
AATGACGTAACGGTTAAAGTCCACAAAAACCACCCAGAAAACCGCACGCGAACCTACGCCCAGAAACGAA
AGCCAAAAAACCCACAACTTCCTCAAATCTTCACTTCCGTTTTCCCACGATACGTCACTTCCCATTTTAA
AAAAAAACTACAATTCCCAATACATGCAAGTTACTCCGCCCTAAAACCTACGTCACCCGCCCCGTTCCCA
```

FIG. 59 (continued)

SEQ ID NO:34 (continued)

```
CGCCCCGCGCCACGTCACAAACTCCACCCCCTCATTATCATATTGGCTTCAATCCAAAATAAGGTATATT
ATTGATGATGGCGAT
```

FIG. 59 (continued)

SEQ ID NO:35

```
CGCCATCATCAATAATATACCTTATTTTGGATTGAAGCCAATATGATAATGAGGGGGTGGAGTTTGTGAC
GTGGCGCGGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTTACGTGGAGACTCGCCCAGGTGTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGGTAAAGAGGGAGCGGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGTGGTTATTATGA
ATGTGAGGTTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGGTGGTGTGTCGCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC
GCACCAGGTGCAGACCCTGCGAGTGTGGCGGTAAACATATTAGGAACCAGCCTGTGATGCTGGATGTGAC
```

FIG. 60

SEQ ID NO:35 (continued)

```
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGGATATGAG
ATGCATCTTGGACTGTATTTTTAGGTTGGCTATGTTCCCAGCCATATCCCTCCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGGATCATGTCTACCTG
CGGGGCGATGAAGAAAACCGTTTCCGGGGTAGGGGAGATCAGCTGGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGGCCACTTCGTTAAGCATGTCCCTGACTTGCATGTTTTCCCT
GACCAAATCCGCCAGAAGGCGCTCGCCGCCCAGCGATAGCAGTTCTTGCAAGGAAGCAAAGTTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGGCGCCGCACGAGGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCTGGTCAGAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGACCCCATGGCATGGGTGGGTGAGCGCGGAGGCG
TACATGCCGCAAATGTCGTAAACGTAGAGGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
CGCGCAGCTTGTTGACCAGCTCGGCGGTGACCTGCACGTCTAGGGCGCAGTAGTCCAGGGTTTCCTTGAT
```

SEQ ID NO:35 (continued)

```
GATGTCATACTTATCCTGTCCCTTTTTTTTCCACAGCTCGCGGTTGAGGACAAACTCTTCGCGGTCTTTC
CAGTACTCTTGGATCGGAAACCCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAAGTCCGTGCGCTTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCCGCGGCGCGACTACGGTACCGCGCGG
CGGGCGGTGGGCCGCGGGGGTGTCCTTGGATGATGCATCTAAAAGCGGTGACGCGGGCGGGCCCCCGGAG
GTAGGGGGGCTCGGGACCCGCCGGGAGAGGGGGCAGGGGCACGTCGGCGCCGCGCGGGCAGGAGCTG
GTGCTGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCCAAGGCCTCAAGGCGCTCCATGGCCTCGTAGAAGTCCACGG
CGAAGTTGAAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGGCCTCTTCTTCTTCTTCAATCTCCTCTTCCATA
AGGGCCTCCCCTTCTTCTTCTTCTGGCGGCGGTGGGGGAGGGGGGACACGGCGGCGACGACGGCGCACCG
GGAGGCGGTCGACAAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAAGTGCGGCGGCGG
CTGGCGGTAGAGGGCCAGCGTAGGGTGGCCGGGGCTCCGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
TAAATTCGCAAGGGTATCATGGCGGACGACCGGGGTTCGAACCCCGGATCCGGCCGTCCGCCGTGATCCA
```

SEQ ID NO:35 (continued)

```
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGGTTTGACCCCGTCACTGGTCTTGTCATGCCTGGGGTATATA
CAAACGAAGCCTTCCATCCAGACATCATTTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCCGGTGGTGGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTTGGCGCGCCCGCCAGCCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GGCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
ACACCCAGTGCGCGTGCGCGGGCACTACCGCGCGCCCTGGGGCGCGCACAAACGCGGCCGCACTGGGCGC
```

SEQ ID NO:35 (continued)

```
ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAAGAAGAGATGCTCCAGGTCATCGCGCCGGAGATCTA
TGGCCCCCCGAAGAAGGAAGAGCAGGATTACAAGCCCCGAAAGCTAAAGCGGGTCAAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCCGGCGTCCGCGCCGTTCAAGGAAGTACGGCGCCGCCAGCGCGCTACTGCCCGAATATGCCCT
ACATCCTTCCATCGCGCCTACCCCGGCTATCGTGGCTACACCTACCGCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAAATAAAAGTCTGGACTCTCACGCTCGCTTGGTCCTGTAACTATTTT
GTAGAATGGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CCGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTCTGGGGGTGCAATCCCTGAAGCGCCGACGATGCTTCTGATCGCGGCCGCGA
TATCGCTAGCGAAGTTCCTATTCTCTAGAAAGTATAGGAACTTCTCGAGCACGTGTTGACAATTAATCAT
CGGCATAGTATATCGGCATAGTATAATACGACAAGGTGAGGAACTAAACCATGGCCAAGTTGACCAGTGC
CGTTCCGGTGCTCACCGCGCGCGACGTCGCCGGAGCGGTCGAGTTCTGGACCGACCGGCTCGGGTTCTCC
CGGGACTTCGTGGAGGACGACTTCGCCGGTGTGGTCCGGGACGACGTGACCCTGTTCATCAGCGCGGTCC
AGGACCAGGTGGTGCCGGACAACACCCTGGCCTGGGTGTGGGTGCGCGGCCTGGACGAGCTGTACGCCGA
GTGGTCGGAGGTCGTGTCCACGAACTTCCGGGACGCCTCCGGGCCGGCCATGACCGAGATCGGCGAGCAG
CCGTGGGGGCGGGAGTTCGCCCTGCGCGACCCGGCCGGCAACTGCGTGCACTTCGTGGCCGAGGAGCAGG
ACTGAGAATTCGAAGTTCCTATTCTCTAGAAAGTATAGGAACTTCTCGAGCACGGGATCCTCTAGAGTCG
ATAGCTAACGTGTCGTATGTGTGTCATGTATGCGTCCATGTCGCCGCCAGAGGAGCTGCTGAGCCGCCGC
GCGCCCGCTTTCCAAGATGGCTACCCCTTCGATGATGCCGCAGTGGTCTTACATGCACATCTCGGGCCAG
GACGCCTCGGAGTACCTGAGCCCCGGGCTGGTGCAGTTTGCCCGCGCCACCGAGACGTACTTCAGCCTGA
ATAACAAGTTTAGAAACCCCACGGTGGCGCCTACGCACGACGTGACCACAGACCGGTCCCAGCGTTTGAC
GCTGCGGTTCATCCCTGTGGACCGTGAGGATACTGCGTACTCGTACAAGGCGCGGTTCACCCTAGCTGTG
```

SEQ ID NO:35 (continued)

```
GGTGATAACCGTGTGCTGGACATGGCTTCCACGTACTTTGACATCCGCGGCGTGCTGGACAGGGGCCCTA
CTTTTAAGCCCTACTCTGGCACTGCCTACAACGCCCTGGCTCCCAAGGGTGCCCCAAATCCTTGCGAATG
GACATATAAAGCCGATGGTGAAACTGCCACAGAAAAAACCCACGTATTTGGGCAGGCGCCTTATTCTGGT
ATAAATATTACAAAAGATGGTATTCAACTTGGAACTGACACCGATGATCAGCCAATCTACGCAGATAAAA
CATTTCAACCTGAACCTCAAATAGGAGAATCTCAGTGGTACGAAACTGAAATTAATCATGCAGCTGGGAG
AGTCCTTAAAAGACTACCCCAATGAAACCATGTTACGGTTCATATGCAAAACCCACAAATGAAATGGA
GGGCAAGCAAATGTGAAAACAGGAACAGGCACTACTAAAGAATATGACATAGACATGCAATTTTTCGACA
ACAGAAGTGCGGCTGCTGCTGGCCTAGCTCCAGAAGTGGTATTGTACAGTGAAGATGTAGATATAGAAAC
CCCAGACACTCATATTTCTTACATGCCCACTATTAAGGAAGGTAACTCACGAGAACTAATGGGCCAACAA
TCTATGCCCAACAGGCCTAATTACATTGCTTTTAGGGACAATTTTATTGGTCTAATGTATTACAACAGCA
CGGGTAATATGGGTGTTCTGGCGGGCCAAGCATCGCAGTTGAATGCTGTTGTAGATTTGCAAGACAGAAA
CACAGAGCTTTCATACCAGCTTTTGCTTGATTCCATTGGTGATAGAACCAGGTACTTTTCTATGTGGAAT
CAGGCTGTTGACAGCTATGATCCAGATGTTAGAATTATTGAAAATCATGGAACTGAAGATGAACTTCCAA
ATTACTGCTTTCCACTGGGAGGTGTGATTAGAACAGATACTTATCAGGGAATTAAGGCTAATGGAACTGA
TCAAACCACATGGACCAAAGATGACAGTGTCAATGATGCTAATGAGGAAATAAGAGTTGGAAATAATTTT
GCCATGGAAATCAATCTAAATGCCAACCTGTGGAGAAATTTCCTGTACTCCAACATAGCGCTGTATTTGC
CCGACAAGCTAAAGTACAGTCCTTCCAACGTAAAAATTTCTGATAACCCAAACACCTACGACTACATGAA
CAAGCGAGTGGTGGCTCCCGGGTTAGTGGACTGCTACATTAACCTTGGAGCACGCTGGTCCCTTGACTAT
ATGGACAACGTCAACCCATTTAACCACCACCGCAATGCTGGCCTGCGCTACCGCTCAATGTTGCTGGGCA
ATGGTCGCTATGTGCCCTTCCACATCCAGGTGCCTCAGAAGTTCTTTGCCATTAAAAACCTCCTTCTCCT
GCCGGGCTCATACACCTACGAGTGGAACTTCAGGAAGGATGTTAACATGGTTCTGCAGAGCTCTCTGGGA
AACGACCTTAGAGTTGACGGGGCTAGCATTAAGTTTGACAGCATTTGTCTTTACGCCACCTTCTTCCCCA
TGGCCCACAACACGGCCTCCACGCTGGAAGCCATGCTCAGAAATGACACCAACGACCAGTCCTTTAATGA
CTACCTTTCCGCCGCCAACATGCTATATCCCATACCCGCCAACGCCACCAACGTGCCCATCTCCATCCCA
TCGCGCAACTGGGCAGCATTTCGCGGTTGGGCCTTCACACGCTTGAAGACAAAGGAAACCCCTTCCCTGG
GATCAGGCTACGACCCTTACTACACCTACTCTGGCTCCATACCATACCTTGACGGAACCTTCTATCTTAA
TCACACCTTTAAGAAGGTGGCCATTACTTTTGACTCTTCTGTTAGCTGGCCGGGCAACGACCGCCTGCTT
ACTCCCAATGAGTTTGAGATTAAGCGCTCAGTTGACGGGGAGGGCTATAACGTAGCTCAGTGCAACATGA
CAAAGGACTGGTTCCTAGTGCAGATGTTGGCCAACTACAATATTGGCTACCAGGGCTTCTACATTCCAGA
AAGCTACAAAGACCGCATGTACTCGTTCTTCAGAAACTTCCAGCCCATGAGCCGGCAAGTGGTGGACGAT
ACTAAATACAAAGATTATCAGCAGGTTGGAATTATCCACCAGCATAACAACTCAGGCTTCGTAGGCTACC
TCGCTCCCACCATGCGCGAGGGACAAGCTTACCCCGCTAATGTTCCCTACCCACTAATAGGCAAAACCGC
GGTTGATAGTATTACCCAGAAAAAGTTTCTTTGCGACCGCACCCTGTGGCGCATCCCCTTCTCCAGTAAC
TTTATGTCCATGGGTGCGCTCACAGACCTGGGCCAAAACCTTCTCTACGCAAACTCCGCCCACGCGCTAG
ACATGACCTTTGAGGTGGATCCCATGGACGAGCCCACCCTTCTTTATGTTTTGTTTGAAGTCTTTGACGT
GGTCCGTGTGCACCAGCCGCACCGCGGCGTCATCGAGACCGTGTACCTGCGCACGCCCTTCTCGGCCGGC
AACGCCACAACATAAAGAAGCAAGCAACATCAACAACAGCTGCCGCCATGGGCTCCAGTGAGCAGGAACT
GAAAGCCATTGTCAAAGATCTTGGTTGTGGGCCATATTTTTGGGCACCTATGACAAGCGCTTCCCAGGC
TTTGTTTCCCCACACAAGCTCGCCTGCGCCATAGTTAACACGGCCGGTCGCGAGACTGGGGCGTACACT
GGATGGCCTTTGCCTGGAACCCGCGCTCAAAAACATGCTACCTCTTTGAGCCCTTTGGCTTTTCTGACCA
ACGTCTCAAGCAGGTTTACCAGTTTGAGTACGAGTCACTCCTGCGCCGTAGCGCCATTGCCTCTTCCCCC
GACCGCTGTATAACGCTGGAAAAGTCCACCCAAAGCGTGCAGGGGCCCAACTCGGCCGCCTGTGGCCTAT
TCTGCTGCATGTTTCTCCACGCCTTTGCCAACTGGCCCCAAACTCCCATGGATCACAACCCCACCATGAA
CCTTATTACCGGGGTACCCAACTCCATGCTTAACAGTCCCCAGGTACAGCCCACCCTGCGCCGCAACCAG
GAACAGCTCTACAGCTTCCTGGAGCGCCACTCGCCCTACTTCCGCAGCCACAGTGCGCAAATTAGGAGCG
CCACTTCTTTTGTCACTTGAAAAACATGTAAAAATAATGTACTAGGAGACACTTTCAATAAAGGCAAAT
GTTTTATTTGTACACTCTCGGGTGATTATTTACCCCACCCTTGCCGTCTGCGCCGTTTAAAAATCAAA
GGGGTTCTGCCGCGCATCGCTATGCGCCACTGGCAGGGACACGTTGCGATACTGGTGTTTAGTGCTCCAC
TTAAACTCAGGCACAACCATCCGCGGCAGCTCGGTGAAGTTTTCACTCCACAGGCTGCGCACCATCACCA
ACGCGTTTAGCAGGTCGGGCGCCGATATCTTGAAGTCGCAGTTGGGGCCTCCGCCCTGCGCGCGCGAGTT
GCGATACACAGGGTTACAGCACTGGAACACTATCAGCGCCGGGTGGTGCACGCTGGCCAGCACGCTCTTG
TCGGAGATCANATCCGCGTCCAGGTCCTCCGCGTTGCTCAGGGCGAACGGAGTCAACTTTGGTAGCTGCC
```

FIG. 60 (continued)

SEQ ID NO:35 (continued)

```
TTCCCAAAAAGGGTGCATGCCCAGGCTTTGAGTTGCACTCGCACCGTAGTGGCATCAGAAGGTGACCGTG
CCCAGTCTGGGCGTTAGGATACAGCGCCTGCATGAAAGCCTTGATCTGCTTAAAAGCCACCTGAGCCTTT
GCGCCTTCAGAGAAGAACATGCCGCAAGACTTGCCGGAAAACTGATTGGCCGGACAGGCCGCGTCATGCA
CGCAGCACCTTGCGTCGGTGTTGGAGATCTGCACCACATTTCGGCCCCACCGGTTCTTCACGATCTTGGC
CTTGCTAGACTGCTCCTTCAGCGCGCGCTGCCCGTTTTCGCTCGTCACATCCATTTCAATCACGTGCTCC
TTATTTATCATAATGCTCCCGTGTAGACACTTAAGCTCGCCTTCGATCTCAGCGCAGCGGTGCAGCCACA
ACGCGCAGCCCGTGGGCTCGTGGTGCTTGTAGGTTACCTCTGCAAACGACTGCAGGTACGCCTGCAGGAA
TCGCCCCATCATCGTCACAAGGTCTTGTTGCTGGTGAAGGTCAGCTGCAACCCGCGGTGCTCCTCGTTT
AGCCAGGTCTTGCATACGGCCGCCAGAGCTTCCACTTGGTCAGGCAGTAGCTTGAAGTTTGCCTTTAGAT
CGTTATCCACGTGGTACTTGTCCATCAACGCGCGCGCAGCCTCCATGCCCTTCTCCCACGCAGACACGAT
CGGCAGGCTCAGCGGGTTTATCACCGTGCTTTCACTTTCCGCTTCACTGGACTCTTCCTTTTCCTCTTGC
ATCCGCATACCCCGCGCCACTGGGTCGTCTTCATTCAGCCGCCGCACCGTGCGCTTACCTCCCTTGCCGT
GCTTGATTAGCACCGGTGGGTTGCTGAAACCCACCATTTGTAGCGCCACATCTTCTCTTTCTTCCTCGCT
GTCCACGATCACCTCTGGGGATGGCGGGCGCTCGGGCTTGGGAGAGGGGCGCTTCTTTTCTTTTGGAC
GCAATGGCCAAATCCGCCGTCGAGGTCGATGGCCGCGGGCTGGGTGTGCGCGGCACCAGCGCATCTTGTG
ACGAGTCTTCTTCGTCCTCGGACTCGAGACGCCGCCTCAGCCGCTTTTTGGGGCGCGCGGGGAGGCGG
CGGCGACGGCGACGGGACGAGACGTCCTCCATGGTTGGTGGACGTCGCGCCGCACCGCGTCCGCGCTCG
GGGGTGGTTTCGCGCTGCTCCTCTTCCCGACTGGCCATTTCCTTCTCCTATAGGCAGAAAAAGATCATGG
AGTCAGTCGAGAAGGAGGACAGCCTAACCGCCCCCTTTGAGTTCGCCACCACCGCCTCCACCGATGCCGC
CAACGCGCCTACCACCTTCCCCGTCGAGGCACCCCCGCTTGAGGAGGAGGAAGTGATTATCGAGCAGGAC
CCAGGTTTTGTAAGCGAAGACGACGAAGATCGCTCAGTACCAACAGAGGATAAAAAGCAAGACCAGGACG
ACGCAGAGGCAAACGAGGAACAAGTCGGGCGGGGGGACCAAAGGCATGGCGACTACCTAGATGTGGGAGA
CGACGTGCTGTTGAAGCATCTGCAGCGCCAGTGCGCCATTATCTGCGACGCGTTGCAAGAGCGCAGCGAT
GTGCCCCTCGCCATAGCGGATGTCAGCCTTGCCTACGAACGCCACCTGTTCTCACCGCGCGTACCCCCA
AACGCCAAGAAAACGGCACATGCGAGCCCAACCCGCGCCTCAACTTCTACCCCGTATTTGCCGTGCCAGA
GGTGCTTGCCACCTATCACATCTTTTTCCAAAACTGCAAGATACCCCTATCCTGCCGTGCCAACCGCAGC
CGAGCGGACAAGCAGCTGGCCTTGCGGCAGGGCGCTGTCATACCTGATATCGCCTCGCTCGACGAAGTGC
CAAAAATCTTTGAGGGTCTTGGACGCGACGAGAAGCGCGCGGCAAACGCTCTGCAACAAGAAAACAGCGA
AAATGAAAGTCACTGTGGAGTGCTGGTGGAACTTGAGGGTGACAACGCGCGCCTAGCCGTGCTGAAACGC
AGCATCGAGGTCACCCACTTTGCCTACCCGGCACTTAACCTACCCCCAAGGTTATGAGCACAGTCATGA
GCGAGCTGATCGTGCGCCGTGCACGACCCCTGGAGAGGGATGCAAACTTGCAAGAACAAACCGAGGAGGG
CCTACCCGCAGTTGGCGATGAGCAGCTGGCGCGCTGGCTTGAGACGCGCGAGCCTGCCGACTTGGAGGAG
CGACGCAAGCTAATGATGGCCGCAGTGCTTGTTACCGTGGAGCTTGAGTGCATGCAGCGGTTCTTTGCTG
ACCCGGAGATGCAGCGCAAGCTAGAGGAAACGTTGCACTACACCTTTCGCCAGGGCTACGTGCGCCAGGC
CTGCAAAATTTCCAACGTGGAGCTCTGCAACCTGGTCTCCTACCTTGGAATTTTGCACGAAAACCGCCTT
GGGCAAAACGTGCTTCATTCCACGCTCAAGGGCGAGGCGCGCCGCGACTACGTCCGCGACTGCGTTTACT
TATTTCTGTGCTACACCTGGCAAACGGCCATGGGCGTGTGGCAGCAGTGCCTGGAGGAGCGCAACCTGAA
GGAGCTGCAGAAGCTGCTAAAGCAAAACTTGAAGGACCTATGGACGGCCTTCAACGAGCGCTCCGTGGCC
GCGCACCTGGCGGACATTATCTTCCCCGAACGCCTGCTTAAAACCCTGCAACAGGGTCTGCCAGACTTCA
CCAGTCAAAGCATGTTGCAAAACTTTAGGAACTTTATCCTAGAGCGTTCAGGAATTCTGCCCGCACCTG
CTGTGCGCTTCCTAGCGACTTTGTGCCCATTAAGTACCGTGAATGCCCTCCGCCGCTTTGGGGTCACTGC
TACCTTNTGCAGCTAGCCAACTACCTTGCCTACCACTCCGACATCATGGAAGACGTGAGCGGTGACGGCC
TACTGGAGTGTCACTGTCGCTGCAACCTATGCACCCGCACCGCTCCCTGGTCTGCAATTCACAACTGCT
TAGCGAAAGTCAAATTATCGGTACCTTTGAGCTGCAGGGTCCCTCGCCTGACGAAAAGTCCGCGGCTCCG
GGGTTGAAACTCACTCCGGGGCTGTGGACGTCGGCTTACCTTCGCAAATTTGTACCTGAGGACTACCACG
CCCACGAGATTAGGTTCTACGAAGACCAATCCCGCCCGCCAAATGCGGAGCTTACCGCCTGCGTCATTAC
CCAGGGCCACATCCTTGGCCAATTGCAAGCCATTAACAAAGCCCGCCAAGAGTTTCTGCTACGAAAGGGA
CGGGGGGTTTACTTGGACCCCCAGTCCGGCGAGGAGCTCAACCCAATCCCCCGCCGCCGCAGCCCTATC
AGCAGCCGCGGGCCCTTGCTTCCCAGGATGGCACCCAAAAAGAAGCTGCAGCTGCCGCCGCCGCCACCCA
CGGACGAGGAGGAATACTGGGACAGTCAGGCAGAGGAGGTTTTGGACGAGGAGGAGGAGATGATGGAAGA
CTGGGACAGCCTAGACGAGGAAGCTTCCGAGGCCGAAGAGGTGTCAGACGAAACACCGTCACCCTCGGTC
GCATTCCCCTCGCCGGCGCCCCAGAAATCGGCAACCGTTCCCAGCATTGCTACAACCTCCGCTCCTCAGG
```

FIG. 60 (continued)

SEQ ID NO:35 (continued)

```
CGCCGCCGGCACTGCCCGTTCGCCGACCCAACCGTAGATGGGACACCACTGGAACCAGGGCCGGTAAGTC
TAAGCAGCCGCCGCCGTTAGCCCAAGAGCAACAACAGCGCCAAGGCTACCGCTCGTGGCGCGTGCACAAG
AACGCCATAGTTGCTTGCTTGCAAGACTGTGGGGGCAACATCTCCTTCGCCCGCCGCTTTCTTCTCTACC
ATCACGGCGTGGCCTTCCCCCGTAACATCCTGCATTACTACCGTCATCTCTACAGCCCCTACTGCACCGG
CGGCAGCGGCAGCAACAGCAGCGGCCACGCAGAAGCAAAGGCGACCGGATAGCAAGACTCTGACAAAGCC
CAAGAAATCCACAGCGGCGGCAGCAGCAGGAGGAGGAGCACTGCGTCTGGCGCCAACGAACCCGTATCG
ACCCGCGAGCTTAGAAACAGGATTTTTCCCACTCTGTATGCTATATTTCAACAGAGCAGGGGCCAAGAAC
AAGAGCTGAAAATAAAAAACAGGTCTCTGCGCTCCCTCACCCGCAGCTGCCTGTATCACAAAAGCGAAGA
TCAGCTTCGGCGCACGCTGGAAGACGCGGAGGCTCTCTTCAGCAAATACTGCGCGCTGACTCTTAAGGAC
TAGTTTCGCGCCCTTTCTCAAATTTAAGCGCGAAAACTACGTCATCTCCAGCGGCCACACCCGGCGCCAG
CACCTGTCGTCAGCGCCATTATGAGCAAGGAAATTCCCACGCCCTACATGTGGAGTTACCAGCCACAAAT
GGGACTTGCGGCTGGAGCTGCCCAAGACTACTCAACCCGAATAAACTACATGAGCGCGGGACCCCACATG
ATATCCCGGGTCAACGGAATCCGCGCCCACCGAAACCGAATTCTCCTCGAACAGGCGGCTATTACCACCA
CACCTCGTAATAACCTTAATCCCCGTAGTTGGCCCGCTGCCCTGGTGTACCAGGAAAGTCCCGCTCCCAC
CACTGTGGTACTTCCCAGAGACGCCCAGGCCGAAGTTCAGATGACTAACTCAGGGGCGCAGCTTGCGGGC
GGCTTTCGTCACAGGGTGCGGTCGCCCGGGCAGGGTATAACTCACCTGAAAATCAGAGGGCGAGGTATTC
AGCTCAACGACGAGTCGGTGAGCTCCTCTCTTGGTCTCCGTCCGGACGGGACATTTCAGATCGGCGGCGC
TGGCCGCTCTTCATTTACGCCCGTCAGGCGATCCTAACTCTGCAGACCTCGTCCTCGGAGCCGCGCTCC
GGAGGCATTGGAACTCTACAATTTATTGAGGAGTTCGTGCCTTCGGTTTACTTCAACCCCTTTTCTGGAC
CTCCCGGCCACTACCCGGACCAGTTTATTCCCAACTTTGACGCGGTAAAAGACTCGGCGGACGGCTACGA
CTGACAGATCTGAGCTCGCGGCCGCGATATCGCTAGCGAAGTTCCTATTCTCTAGAAAGTATAGGAACTT
CGATCCTCTAGAGTCGACCTGCAGGCATGCAAGCTTGGCACTGCAATAAATTACTTACTTAAAATCAGTC
AGCAAATCTTTGTCCAGCTTATTCAGCATCACCTCCTTTCCCTCCTCCCAACTCTGGTATTTCAGCAGCC
TTTTAGCTGCGAACTTTCTCCAAAGTCTAAATGGGATGTCAAATTCCTCATGTTCTTGTCCCTCCGCACC
CACTATCTTCATATTGTTGCAGATGAAACGCGCCAGACCGTCTGAAGACACCTTCAACCCTGTGTACCCA
TATGACACGGAAACCGGCCCTCCAACTGTGCCTTTCCTTACCCCTCCCTTTGTGTCGCCAAATGGGTTCC
AAGAAAGTCCCCCCGGAGTGCTTTCTTTGCGTCTTTCAGAACCTTTGGTTACCTCACACGGCATGCTTGC
GCTAAAAATGGGCAGCGGCCTGTCCCTGGATCAGGCAGGCAACCTTACATCAAATACAATCACTGTTTCT
CAACCGCTAAAAAAACAAAGTCCAATATAACTTTGGAAACATCCGCGCCCCTTACAGTCAGCTCAGGCG
CCCTAACCATGGCCACAACTTCGCCTTTGGTGGTCTCTGACAACACTCTTACCATGCAATCACAAGCACC
GCTAACCGTGCAAGACTCAAAACTTAGCATTGCTACCAAAGAGCCACTTACAGTGTTAGATGGAAAACTG
GCCCTGCAGACATCAGCCCCCTCTCTGCCACTGATAACAACGCCCTCACTATCACTGCCTCACCTCCTC
TTACTACTGCAAATGGTAGTCTGGCTGTTACCATGGAAAACCCACTTTACAACAACAATGGAAAACTTGG
GCTCAAAATTGGCGGTCCTTTGCAAGTGGCCACCGACTCACATGCACTAACACTAGGTACTGGTCAGGGG
GTTGCAGTTCATAACAATTTGCTACATACAAAAGTTACAGGCGCAATAGGGTTTGATACATCTGGCAACA
TGGAACTTAAAACTGGAGATGGCCTCTATGTGGATAGCGCCGGTCCTAACCAAAAACTACATATTAATCT
AAATACCACAAAAGGCCTTGCTTTTGACAACACCGCAATAACAATTAACGCTGGAAAAGGGTTGGAATTT
GAAACAGACTCCTCAAACGGAAATCCCATAAAAACAAAAATTGGATCAGGCATACAATATAATACCAATG
GAGCTATGGTTGCAAAACTTGGAACAGGCCTCAGTTTTGACAGCTCCGGAGCCATAACAATGGGCAGCAT
AAACAATGACAGACTTACTCTTTGGACAACACCAGACCCATCCCCAAATTGCAGAATTGCTTCAGATAAA
GACTGCAAGCTAACTCTGGCGCTAACAAAATGTGGCAGTCAAATTTTGGGCACTGTTTCAGCTTTGGCAG
TATCAGGTAATATGGCCTCCATCAATGGAACTCTAAGCAGTGTAAACTTGGTTCTTAGATTTGATGACAA
CGGAGTGCTTATGTCAAATTCATCACTGGACAAACAGTATTGGAACTTTAGAAACGGGGACTCCACTAAC
GGTCAACCATACACTTATGCTGTTGGGTTTATGCCAAACCTAAAAGCTTACCCAAAAACTCAAAGTAAAA
CTGCAAAAAGTAATATTGTTAGCCAGGTGTATCTTAATGGTGACAAGTCTAAACCATTGCATTTACTAT
TACGCTAAATGGAACAGATGAAACCAACCAAGTAAGCAAATACTCAATATCATTCAGTTGGTCCTGGAAC
AGTGGACAATACACTAATGACAAATTTGCCACCAATTCCTATACCTTCTCCTACATTGCCCAGGAATAAA
GAATCGTGAACCTGTTGCATGTTATGTTTCAACGTGTTTATTTTTCAATTCGTATTAGTCATCGCTATTA
CCATGGTGATGCGGTTTTGGCAGTACATCAATGGGCGTGGATAGCGGTTTGACTCACGGGGATTTCCAAG
TCTCCACCCCATTGACGTCAATGGGAGTTTGTTTTGGCACCAAAATCAACGGGACTTTCCAAAATGTCGT
AACAACTCCGCCCCATTGACGCAAATGGGCGGTAGGCGTGTACGGTGGGAGGTCTATATAAGCAGAGCTG
GTTTAGTGAACCGTCAGATCCGCTAGAGATCCACCATGTTTGTCTTTCTCGTGCTGCTGCCCCTCGTGAG
```

FIG. 60 (continued)

SEQ ID NO:35 (continued)

```
CAGCCAGTGCGTCAATCTGACAACAAGGACCCAGCTGCCCCCGCCTACACCAACTCCTTCACAAGAGGC
GTGTATTACCCCGATAAGGTCTTCAGATCCAGCGTCCTCCACAGCACCCAAGATTTGTTTCTGCCTTTCT
TCAGCAACGTGACATGGTTCCACGCCATTCATGTCAGCGGCACAAACGGCACAAAGAGGTTTGACAACCC
CGTGCTCCCCTTCAACGACGGCGTGTACTTCGCCAGCACAGAGAAATCCAATATCATTAGGGGCTGGATC
TTCGGCACAACACTGGATTCCAAGACCCAGTCTCTGCTCATTGTGAATAACGCCACCAACGTGGTGATTA
AGGTCTGTGAGTTTCAGTTCTGCAACGACCCCTTTCTGGGAGTCTACTACCACAAGAATAATAAGAGCTG
GATGGAGTCCGAGTTTAGGGTGTACAGCTCCGCCAACAACTGTACCTTCGAATACGTGTCCCAGCCTTTC
CTCATGGATCTGGAGGGCAAGCAAGGCAATTTCAAAAATCTGAGAGAGTTCGTGTTCAAAAACATTGATG
GATACTTCAAAATCTACAGCAAGCATACCCCCATTAATCTGGTGAGGGATCTGCCCCAAGGATTCTCCGC
TCTGGAACCTCTGGTGGATCTGCCCATTGGCATTAACATCACAAGATTCCAGACCCTCCTCGCCCTCCAT
AGATCCTATCTGACCCCCGGCGACTCCTCCAGCGGATGGACAGCCGGAGCTGCCGCCTACTACGTGGGCT
ATCTGCAGCCAAGAACCTTTCTGCTGAAGTACAACGAGAACGGCACCATCACAGACGCTGTCGATTGCGC
TCTCGACCCTCTGAGCGAGACCAAATGCACACTGAAGAGCTTCACCGTGGAAAAGGGCATCTATCAGACC
AGCAACTTCAGAGTGCAGCCTACCGAGAGCATTGTGAGGTTTCCCAACATCACCAATCTGTGTCCTTTCG
GCGAGGTCTTTAATGCCACAAGGTTCGCTTCCGTGTATGCTTGGAATAGGAAGAGGATCAGCAATTGCGT
CGCCGACTATTCCGTCCTCTATAACAGCGCCTCCTTCTCCACCTTCAAATGTTATGGCGTGTCCCCCACC
AAGCTCAACGACCTCTGCTTCACCAATGTGTACGCTGACTCCTTCGTCATTAGGGGCGACGAGGTGAGGC
AAATTGCCCCCGGCCAGACCGGCAAGATTGCTGATTACAACTACAAACTGCCCGACGATTTTACCGGCTG
CGTGATCGCTTGGAACTCCAACAATCTGGACTCCAAAGTGGGCGGAAACTACAATTACCTCTACAGACTC
TTTAGAAAAAGCAATCTGAAGCCCTTCGAGAGAGACATCTCCACCGAAATCTACCAAGCCGGAAGCACAC
CTTGCAATGGCGTCGAGGGATTTAACTGCTACTTCCCTCTGCAGAGCTACGGCTTTCAACCTACCAACGG
CGTCGGATATCAACCCTATAGGGTGGTCGTGCTGAGCTTTGAACTGCTGCATGCTCCCGCCACCGTCTGC
GGACCTAAGAAGAGCACCAATCTCGTCAAAAACAAGTGCGTGAACTTCAACTTCAATGGACTGACCGGCA
CCGGCGTGCTGACCGAGAGCAATAAGAAGTTTCTGCCCTTCCAGCAGTTCGGAAGGGATATTGCCGATAC
CACAGATGCTGTGAGGGACCCCCAAACCCTCGAGATTCTGGATATCACCCCTTGCAGCTTCGGAGGAGTG
TCCGTGATCACCCCCGGAACAAACACCTCCAATCAAGTGGCTGTGCTGTACCAAGACGTGAACTGCACAG
AAGTCCCCGTGGCCATCCATGCCGACCAGCTGACCCCTACATGGAGAGTGTACTCCACCGGCAGCAATGT
GTTCCAGACAAGAGCCGGATGCCTCATTGGAGCTGAACACGTCAACAACAGCTACGAGTGCGACATTCCC
ATCGGCGCCGGCATTTGTGCCTCCTATCAGACCCAGACCAACAGCCCAAGAAGGGCTAGAAGCGTCGCTT
CCCAATCCATCATTGCCTACACCATGTCTCTGGGAGCCGAAAACTCCGTCGCCTACTCCAACAATAGCAT
CGCCATCCCCACCAATTTTACCATCTCCGTGACCACAGAGATTCTGCCCGTGTCCATGACAAAGACATCC
GTGGACTGCACCATGTACATCTGTGGCGACAGCACCGAGTGTAGCAATCTGCTGCTGCAATATGGCAGCT
TCTGCACCCAGCTGAACAGAGCCCTCACCGGCATCGCCGTCGAACAAGACAAGAACACCCAAGAGGTGTT
CGCCCAAGTGAAGCAAATCTACAAGACCCCCCCTATCAAAGATTTCGGAGGATTCAACTTTAGCCAGATT
CTGCCCGATCCTAGCAAGCCTTCCAAGAGGAGCTTCATCGAGGATCTGCTGTTTAATAAGGTGACACTGG
CCGACGCTGGCTTCATTAAACAGTACGGCGATTGTCTGGGCGACATCGCTGCTAGGGATCTGATCTGCGC
TCAGAAGTTCAACGGACTGACAGTCCTCCCTCCTCTGCTGACCGACGAGATGATCGCTCAGTATACCAGC
GCTCTGCTGGCTGGAACCATTACCAGCGGCTGGACATTCGGCGCTGGAGCCGCCCTCCAAATTCCCTTTG
CCATGCAGATGGCCTATAGATTCAACGGCATTGGCGTCACCCAAAATGTGCTGTATGAAAATCAGAAGCT
GATTGCTAACCAATTCAATAGCGCCATTGGCAAGATCCAAGACTCTCTGAGCTCCACAGCCAGCGCCCTC
GGAAAGCTGCAAGACGTGGTGAATCAAAACGCCCAAGCTCTGAACACACTGGTGAAACAGCTCAGCAGCA
ACTTTGGAGCCATCAGCAGCGTGCTCAATGATATCCTCTCTAGGCTGGACCCTCCGGAGGCCGAAGTCCA
GATCGATAGACTCATCACCGGCAGACTCCAATCTCTGCAGACATACGTCACCCAACAGCTCATTAGAGCT
GCCGAAATCAGAGCCTCCGCCAATCTGGCCGCCACCAAGATGTCCGAGTGCGTGCTGGGACAGAGCAAGA
GAGTGGACTTCTGTGGCAAGGGATACCATCTGATGAGCTTCCCCAGAGCGCTCCCCATGGAGTGGTCTT
TCTGCATGTCACATACGTGCCCGCCCAAGAGAAGAACTTCACCACCGCTCCCGCCATTTGCCACGATGGA
AAGGCCCACTTTCCCAGAGAAGGAGTGTTCGTGAGCAACGGCACACACTGGTTTGTCACCCAGAGAAATT
TTTACGAGCCCCAGATTATCACCACCGACAACACCTTCGTGTCCGGAAACTGCGATGTCGTGATTGGCAT
CGTGAACAACACAGTCTACGACCCTCTGCAGCCCGAACTCGACAGCTTCAAGGAAGAGCTGGACAAGTAC
TTCAAGAATCACACATCCCCCGACGTGGATCTGGGCGACATTAGCGGCATTAATGCCTCCGTCGTCAACA
TTCAGAAGGAGATTGATAGACTGAATGAAGTCGCCAAGAACCTCAATGAGTCTCTGATTGATCTGCAAGA
GCTGGGCAAGTACGAGCAATACATCAAATGGCCTTGGTACATCTGGCTGGGATTCATCGCTGGACTCATC
```

SEQ ID NO:35 (continued)

```
GCCATCGTGATGGTCACCATTATGCTGTGTTGCATGACCAGCTGCTGCAGCTGTCTGAAGGGCTGCTGCA
GCTGCGGAAGCTGCTGCAAGTTTGACGAAGACGACTCCGAGCCCGTGCTGAAGGGCGTCAAGCTGCATTA
TACATAAACTAGTGCTGGAATTCGCCCTTATAGAGTGCTGGAATTCGCCCTTATAGAGTGCTGGAATTCG
CCCTTATATCTAGTAACGGCCGCCAGTGTGCTGGAATTCGCCCTTATAACTTCGTATAGCATACATTATA
CGAAGTTATAAGGGCGAATTCTGCAGATATCCATCCTTTAAAAAACCTCCCACACCTCCCCCTGAACCTG
AAACATAAATGAATGCAATTGTTGTTGTTAACTTGTTTATTGCAGCTTATAATGGTTACAAATAAAGCA
ATAGCATCACAAATTTCACAAATAAAGCATTTTTTTCACTGCATTCTAGTTGTGGTTTGTCCAAACTCAT
CAATGTATCTTAACAACGTGTTTATTTTCAATTGCAGAAAGAATTGCAGAAAATTTCAAGTCATTTTTC
ATTCAGTAGTATAGCCCCACCACCACATAGCTTATACTAATCACCGTACCTTAATCAAACTCACAGAACC
CTAGTATTCAACCTGCCACCTCCCTCCCAACACACAGAGTACACAGTCCTTTCTCCCGGCTGGCCTTAA
ACAGCATCATATCATGGGTAACAGACATATTCTTAGGTGTTATATTCCACACGGTCTCCTGTCGAGCCAA
ACGCTCATCAGTGATGTTAATAAACTCCCCGGGCAGCTCGCTTAAGTTCATGTCGCTGTCCAGCTGCTGA
GCCACAGGCTGCTGTCCAACTTGCGGTTGCTCAACGGGCGGCGAAGGAGAAGTCCACGCCTACATGGGGG
TAGAGTCATAATCGTGCATCAGGATAGGGCGGTGGTGCTGCAGCAGCGCGCGAATAAACTGCTGCCGCCG
CCGCTCCGTCCTGCAGGAATACAACATGGCAGTGGTCTCCTCAGCGATGATTCGCACCGCCCGCAGCATA
AGGCGCCTTGTCCTCCGGGCACAGCAGCGCACCCTGATCTCACTTAAGTCAGCACAGTAACTGCAGCACA
GTACCACAATATTGTTTAAAATCCCACAGTGCAAGGCGCTGTATCCAAAGCTCATGGCGGGGACCACAGA
ACCCACGTGGCCATCATACCACAAGCGCAGGTAGATTAAGTGGCGACCCCTCATAAACACGCTGGACATA
AACATTACCTCTTTTGGCATGTTGTAATTCACCACCTCCCGGTACCATATAAACCTCTGATTAAACATGG
CGCCATCCACCACCATCCTAAACCAGCTGGCCAAAACCTGCCCGCCGGCTATGCACTGCAGGGAACCGGG
ACTGGAACAATGACAGTGGAGAGCCCAGGACTCGTAACCATGGATCATCATGCTCGTCATGATATCAATG
TTGGCACAACACAGGCACACGTGCATACACTTCCTCAGGATTACAAGCTCCTCCCGCGTCAGAACCATAT
CCCAGGGAACAACCCATTCCTGAATCAGCGTAAATCCCACACTGCAGGGAAGACCTCGCACGTAACTCAC
GTTGTGCATTGTCAAAGTGTTACATTCGGGCAGCAGCGGATGATCCTCCAGTATGGTAGCGCGTGTCTCT
GTCTCAAAAGGAGGTAGGCGATCCCTACTGTACGGAGTGCGCCGAGACAACCGAGATCGTGTTGGTCGTA
GTGTCATGCCAAATGGAACGCCGGACGTAGTCATATTTCCTGAAGCAAAACCAGGTGCGGGCGTGACAAA
CAGATCTGCGTCTCCGGTCTCGTCGCTTAGCTCGCTCTGTGTAGTAGTTGTAGTATATCCACTCTCTCAA
AGCATCCAGGCGCCCCCTGGCTTCGGGTTCTATGTAAACTCCTTCATGCGCCGCTGCCCTGATAACATCC
ACCACCGCAGAATAAGCCACACCCAGCCAACCTACACATTCGTTCTGCGAGTCACACACGGGAGGAGCGG
GAAGAGCTGGAAGAACCATGTTTTTTTTTTTATTCCAAAAGATTATCCAAAACCTCAAAATGAAGATCT
ATTAAGTGAACGCGCTCCCCTCCGGTGGCGTGGTCAAACTCTACAGCCAAGAACAGATAATGGCATTTG
TAAGATGTTGCACAATGGCTTCCAAAAGGCAAACTGCCCTCACGTCCAAGTGGACGTAAAGGCTAAACCC
TTCANGGTGAATCTCCTCTATAAACATTCCAGCACCTTCAACCATGCCCAAATAATTTTCATCTCGCCAC
CTTATCAATATGTCTCTAAGCAAATCCCGAATATTAAGTCCGGCCATTGTAAAAATCTGCTCCAGAGCGC
CCTCCACCTTCAGCCTCAAGCAGCGAATCATGATTGCAAAAATTCAGGTTCCTCACAGACCTGTATAAGA
TTCAAAAGCGGAACATTAACAAAATACCGCGATCCCGTAGGTCCCTTCGCAGGGCCAGCTGAACATAAT
CGTGCAGGTCTGCACGGACCAGCGCGGCCACTTCCCCGCCAGGAACCATGACAAAAGAACCCACACTGAT
TATGACACGCATACTCGGAGCTATGCTAACCAGCGTAGCCCCGATGTAAGCTTGTTGCATGGGCGGCGAT
ATAAAATGCAAGGTACTGCTCAAAAAATCAGGCAAAGCCTCGCGCAAAAAGCAAGCACATCGTAGTCAT
GCTCATGCAGATAAAGGCAGGTAAGTTCCGGAACCACCACAGAAAAGACACCATTTTTCTCTCAAACAT
GTCTGCGGGTTCCTGCATAAACACAAAATAAAATAACAAAAAAAAAAAAACATTTAAACATTAGAAGCCT
GTCTTACAACAGGAAAAACAACCCTTATAAGCATAAGACGGACTACGGCCATGCCGGCGTGACCGTAAAA
AAACTGGTCACCGTGATTAAAAAGCACCACCGACAGTTCCTCGGTCATGTCCGGAGTCATAATGTAAGAC
TCGGTAAACACATCAGGTTGGTTAACATCGGTCAGTGCTAAAAGCGACCGAAATAGCCCGGGGAATAC
ATACCCGCAGGCGTAGAGACAACATTACAGCCCCATAGGAGGTATAACAAAATTAATAGGAGAGAAAA
CACATAAACCCCTGAAAAACCCTCCTGCCCCTAGGCAAAATAGCACCCTCCCGCTCCAGAACAACATACA
GCGCTTCCACAGCGGCAGCCATAACAGTCAGCCTTACCAGTAAAAAAACCTATTAAAAAACACCACTCGA
CACGGCACCAGCTCAATCAGTCACAGTGTAAAAAGGGCCAAGTACAGAGCGAGTATATATAGGACTAAAA
AATGACGTAACGGTTAAAGTCCACAAAAACCACCCAGAAAACCGCACGCGAACCTACGCCCAGAAACGAA
AGCCAAAAAACCCACAACTTCCTCAAATCTTCACTTCCGTTTTCCCACGATACGTCACTTCCCATTTTAA
AAAAAAACTACAATTCCCAATACATGCAAGTTACTCCGCCCTAAAACCTACGTCACCCGCCCCGTTCCCA
```

SEQ ID NO:35 (continued)
CGCCCCGCGCCACGTCACAAACTCCACCCCCTCATTATCATATTGGCTTCAATCCAAAATAAGGTATATT
ATTGATGATGGCGAT FIG. 60 (continued)

SEQ ID NO:36

```
CGCCATCATCAATAATATACCTTATTTTGGATTGAAGCCAATATGATAATGAGGGGGTGGAGTTTGTGAC
GTGGCGCGGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTTACGTGGAGACTCGCCCAGGTGTTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGGTAAAGAGGGAGCGGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGTGGTTATTATGA
ATGTGAGGTTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGGTGGTGTGTCGCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC
GCACCAGGTGCAGACCCTGCGAGTGTGGCGGTAAACATATTAGGAACCAGCCTGTGATGCTGGATGTGAC
```

FIG. 61

SEQ ID NO:36 (continued)

```
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGGATATGAG
ATGCATCTTGGACTGTATTTTTAGGTTGGCTATGTTCCCAGCCATATCCCTCCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGGATCATGTCTACCTG
CGGGGCGATGAAGAAAACCGTTTCCGGGGTAGGGGAGATCAGCTGGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGCCACTTCGTTAAGCATGTCCCTGACTTGCATGTTTTCCCT
GACCAAATCCGCCAGAAGGCGCTCGCCGCCCAGCGATAGCAGTTCTTGCAAGGAAGCAAAGTTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGGCGCCGCACGAGGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCTGGTCAGAAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGACCCCATGGCATGGGTGGGTGAGCGCGGAGGCG
TACATGCCGCAAATGTCGTAAACGTAGAGGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
CGCGCAGCTTGTTGACCAGCTCGGCGGTGACCTGCACGTCTAGGGCGCAGTAGTCCAGGGTTTCCTTGAT
```

SEQ ID NO:36 (continued)

```
GATGTCATACTTATCCTGTCCCTTTTTTTTCCACAGCTCGCGGTTGAGGACAAACTCTTCGCGGTCTTTC
CAGTACTCTTGGATCGGAAACCCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAAGTCCGTGCGCTTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCCGCGGCGCGACTACGGTACCGCGCGG
CGGGCGGTGGGCCGCGGGGTGTCCTTGGATGATGCATCTAAAAGCGGTGACGCGGGCGGGCCCCCGGAG
GTAGGGGGGGCTCGGGACCCGCCGGGAGAGGGGGCAGGGGCACGTCGGCGCCGCGCGGGCAGGAGCTG
GTGCTGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCAAGGCCTCAAGGCGCTCCATGGCCTCGTAGAAGTCCACGG
CGAAGTTGAAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGGCCTCTTCTTCTTCTTCAATCTCCTCTTCCATA
AGGGCCTCCCCTTCTTCTTCTTCTGGCGGCGGTGGGGAGGGGGACACGGCGGCGACGACGGCGCACCG
GGAGGCGGTCGACAAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAAGTGCGGCGGCGG
CTGGCGGTAGAGGGCCAGCGTAGGGTGGCCGGGCTCCGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
TAAATTCGCAAGGGTATCATGGCGGACGACCGGGGTTCGAACCCCGGATCCGGCCGTCCGCCGTGATCCA
```

FIG. 61 (continued)

SEQ ID NO:36 (continued)

```
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGTTTGACCCCGTCACTGGTCTTGTCATGCCTGGGGTATATA
CAAACGAAGCCTTCCATCCAGACATCATTTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCCGGTGGTGGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTTGGCGCGCCCGCCAGCCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GGCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
ACACCCAGTGCGCGTGCGCGGGCACTACCGCGCGCCTGGGGCGCGCACAAACGCGGCCGCACTGGGCGC
```

SEQ ID NO:36 (continued)

```
ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAAGAAGAGATGCTCCAGGTCATCGCGCCGGAGATCTA
TGGCCCCCCGAAGAAGGAAGAGCAGGATTACAAGCCCCGAAAGCTAAAGCGGGTCAAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCGAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCCGGCGTCCGCGCCGTTCAAGGAAGTACGGCGCCGCCAGCGCGCTACTGCCCGAATATGCCCT
ACATCCTTCCATCGCGCCTACCCCCGGCTATCGTGGCTACACCTACCGCCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAAATAAAAGTCTGGACTCTCACGCTCGCTTGGTCCTGTAACTATTTT
GTAGAATGGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CCGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTCTGGGGTGCAATCCCTGAAGCGCCGACGATGCTTCTGATCGCGGCCGCGA
TATCGCTAGCGAATTCGAAGTTCCTATTCTCTAGAAAGTATAGGAACTTCGGATCCTCTAGAGTCGATAG
CTAACGTGTCGTATGTGTGTCATGTATGCGTCCATGTCGCCGCCAGAGGAGCTGCTGAGCCGCCGCGCGC
CGCTTTCCAAGATGGCTACCCCTTCGATGATGCCGCAGTGGTCTTACATGCACATCTCGGGCCAGGACG
CCTCGGAGTACCTGAGCCCCGGCTGGTGCAGTTTGCCCGCGCCACCGAGACGTACTTCAGCCTGAATAA
CAAGTTTAGAAACCCCACGGTGGCGCCTACGCACGACGTGACCACAGACCGGTCCCAGCGTTTGACGCTG
CGGTTCATCCCTGTGGACCGTGAGGATACTGCGTACTCGTACAAGGCGCGGTTCACCCTAGCTGTGGGTG
ATAACCGTGTGCTGGACATGGCTTCCACGTACTTTGACATCCGCGGCGTGCTGGACAGGGGCCCCACTTT
TAAGCCCTACTCCGGCACTGCCTACAACGCCCTAGCTCCCAAGGGTGCCCCAACTCATGCGAGTGGGAT
GAAGATGATACTCAGGTACAGGTAGCGGCTGAAGACGATCAAGACGACGACGAAGAAGAGGAACAACTAC
CTCAGCAGAGAAATGGCAAAAAAACTCACGTATATGCTCAGGCACCGTTTGCTGGCGAAGCAATTAACAA
AAACGGCCTGCAGATAGGAACTAACGGTGCAGCCACTGAAGGAAATAAGGAAATTTACGCAGATAAAACT
TATCAACCTGAACCACAAATAGGAGAATCACAGTGGAACGAAGCCGAATCGTCCGTAGCAGGTGGAAGGG
TTCTTAAAAGACTACTCCCATGAAACCATGCTATGGCTCCTATGCCAGACCTACCAATTCTAACGGAGG
```

FIG. 61 (continued)

SEQ ID NO:36 (continued)

```
TCAGGGCGTTATGGTTGAACAAAATGGTAAATTGGAAAGTCAAGTAGAAATGCAATTTTTTTCAACTTCT
GTAAATGCTATGAACGAGGCAAACGCTATTCAACCTAAACTAGTGTTGTATAGTGAAGATGTAAATATGG
AAACCCCAGACACTCATCTTTCTTATAAGCCTGGAAAAAGTGATGATAATTCTAAGGCAATGTTGGGTCA
ACAATCTATGCCAAACAGACCCAATTACATAGCTTTCAGGGACAATTTTATTGGCCTAATGTATTACAAC
AGCACTGGTAACATGGGTGTTCTTGCTGGTCAGGCATCACAGCTAAATGCTGTCGTAGATTTGCAAGACA
GAAACACAGAGCTGTCCTACCAACTTTTGCTTGATTCTATTGGTGATCGAACCAGATACTTTTCCATGTG
GAATCAGGCTGTAGACAGCTACGATCCAGATGTTAGAATTATCGAGAACCATGGAACTGAGGATGAATTG
CCAAATTATTGTTTTCCTCTTGGCGGAATTGGGGTGACGGACACCTATCAAGCTATTAAGGCTACAAATG
GAAATGGAGGCGCCACTACCTGGGCTCAGGACAATACTTTTGCAGAACGAAATGAAATAGGGGTGGGAAA
TAACTTTGCCATGGAAATTAACCTGAATGCCAACCTATGGAGAAATTTCCTTTACTCCAATATTGCGCTG
TACCTGCCAGACAAGCTAAAATACAACCCCACCAATGTGGAAATATCTGACAATCCCAACACCTACGACT
ACATGAACAAGCGAGTGGTGGCTCCGGGCTGGTGGATTGCTACATTAACCTTGGGGCGCGCTGGTCTCT
GGACTACATGGACAACGTTAATCCCTTTAACCACCACCGCAATGCGGGCCTGCGTTACCGCTCCATGTTG
TTGGGAAACGGCCGCTACGTGCCCTTTCACATTCAGGTGCCCCAAAAGTTTTTTGCCATTAAAAACCTCC
TCCTCCTGCCAGGCTCATACACATATGAATGGAACTTCAGGAAGGATGTTAACATGGTTCTGCAGAGCTC
TCTGGGAAACGACCTTAGAGTTGACGGGGCTAGCATTAAGTTTGACAGCATTTGTCTTTACGCCACCTTC
TTCCCCATGGCCCACAACACGGCCTCCACGCTGGAAGCCATGCTCAGAAATGACACCAACGACCAGTCCT
TTAATGACTACCTTTCCGCCGCCAACATGCTATATCCCATACCCGCCAACGCCACCAACGTGCCCATCTC
CATCCCATCGCGCAACTGGGCAGCATTTCGCGGTTGGGCCTTCACACGCTTGAAGACAAAGGAAACCCCT
TCCCTGGGATCAGGCTACGACCCTTACTACACCTACTCTGGCTCCATACCATACCTTGACGGAACCTTCT
ATCTTAATCACACCTTTAAGAAGGTGGCCATTACTTTTGACTCTTCTGTTAGCTGGCCGGGCAACGACCG
CCTGCTTACTCCCAATGAGTTTGAGATTAAGCGCTCAGTTGACGGGGAGGGCTATAACGTAGCTCAGTGC
AACATGACAAAGGACTGGTTCCTAGTGCAGATGTTGGCCAACTACAATATTGGCTACCAGGGCTTCTACA
TTCCAGAAAGCTACAAAGACCGCATGTACTCGTTCTTCAGAAACTTCCAGCCCATGAGCCGGCAAGTGGT
GGACGATACTAAATACAAAGATTATCAGCAGGTTGGAATTATCCACCAGCATAACAACTCAGGCTTCGTA
GGCTACCTCGCTCCCACCATGCGCGAGGGACAAGCTTACCCCGCTAATGTTCCCTACCCACTAATAGGCA
AAACCGCGGTTGATAGTATTACCCAGAAAAAGTTTCTTTGCGACCGCACCCTGTGGCGCATCCCCTTCTC
CAGTAACTTTATGTCCATGGGTGCGCTCACAGACCTGGGCCAAAACCTTCTCTACGCAAACTCCGCCCAC
GCGCTAGACATGACCTTTGAGGTGGATCCCATGGACGAGCCCACCCTTCTTTATGTTTTGTTTGAAGTCT
TTGACGTGGTCCGTGTGCACCAGCCGCACCGCGGCGTCATCGAGACCGTGTACCTGCGCACGCCCTTCTC
GGCCGGCAACGCCACAACATAAAGAAGCAAGCAACATCAACAACAGCTGCCGCCATGGGCTCCAGTGAGC
AGGAACTGAAAGCCATTGTCAAAGATCTTGGTTGTGGGCCATATTTTTGGGCACCTATGACAAGCGCTT
CCCAGGCTTTGTTTCCCCACACAAGCTCGCCTGCGCCATAGTTAACACGGCCGGTCGCGAGACTGGGGGC
GTACACTGGATGGCCTTTGCCTGGAACCCGCGCTCAAAAACATGCTACCTCTTTGAGCCCTTTGGCTTTT
CTGACCAACGTCTCAAGCAGGTTTACCAGTTTGAGTACGAGTCACTCCTGCGCCGTAGCGCCATTGCCTC
TTCCCCCGACCGCTGTATAACGCTGGAAAAGTCCACCCAAAGCGTGCAGGGGCCCAACTCGGCCGCCTGT
GGCCTATTCTGCTGCATGTTTCTCCACGCCTTTGCCAACTGGCCCCAAACTCCCATGGATCACAACCCCA
CCATGAACCTTATTACCGGGGTACCCAACTCCATGCTTAACAGTCCCCAGGTACAGCCCACCCTGCGCCG
CAACCAGGAACAGCTCTACAGCTTCCTGGAGCGCCACTCGCCCTACTTCCGCAGCCACAGTGCGCAAATT
AGGAGCGCCACTTCTTTTTGTCACTTGAAAAACATGTAAAAATAATGTACTAGGAGACACTTTCAATAAA
GGCAAATGTTTTTATTTGTACACTCTCGGGTGATTATTTACCCCCACCCTTGCCGTCTGCGCCGTTTAAA
AATCAAAGGGGTTCTGCCGCGCATCGCTATGCGCCACTGGCAGGGACACGTTGCGATACTGGTGTTTAGT
GCTCCACTTAAACTCAGGCACAACCATCCGCGGCAGCTCGGTGAAGTTTTCACTCCACAGGCTGCGCACC
ATCACCAACGCGTTTAGCAGGTCGGGCGCCGATATCTTGAAGTCGCAGTTGGGGCCTCCGCCCTGCGCGC
GCGAGTTGCGATACACAGGGTTACAGCACTGGAACACTATCAGCGCCGGTGGTGCACGCTGGCCAGCAC
GCTCTTGTCGGAGATCANATCCGCGTCCAGGTCCTCCGCGTTGCTCAGGGCGAACGGAGTCAACTTTGGT
AGCTGCCTTCCCAAAAAGGGTGCATGCCCAGGCTTTGAGTTGCACTCGCACCGTAGTGGCATCAGAAGGT
GACCGTGCCCAGTCTGGGCGTTAGGATACAGCGCCTGCATGAAAGCCTTGATCTGCTTAAAAGCCACCTG
AGCCTTTGCGCCTTCAGAGAAGAACATGCCGCAAGACTTGCCGGAAAACTGATTGGCCGGACAGGCCGCG
TCATGCACGCAGCACCTTGCGTCGGTGTTGGAGATCTGCACCACATTTCGGCCCCACCGGTTCTTCACGA
TCTTGGCCTTGCTAGACTGCTCCTTCAGCGCGCGCTGCCCGTTTTCGCTCGTCACATCCATTTCAATCAC
GTGCTCCTTATTTATCATAATGCTCCCGTGTAGACACTTAAGCTCGCCTTCGATCTCAGCGCAGCGGTGC
```

FIG. 61 (continued)

SEQ ID NO:36 (continued)

```
AGCCACAACGCGCAGCCCGTGGGCTCGTGGTGCTTGTAGGTTACCTCTGCAAACGACTGCAGGTACGCCT
GCAGGAATCGCCCCATCATCGTCACAAAGGTCTTGTTGCTGGTGAAGGTCAGCTGCAACCCGCGGTGCTC
CTCGTTTAGCCAGGTCTTGCATACGGCCGCCAGAGCTTCCACTTGGTCAGGCAGTAGCTTGAAGTTTGCC
TTTAGATCGTTATCCACGTGGTACTTGTCCATCAACGCGCGCGCAGCCTCCATGCCCTTCTCCCACGCAG
ACACGATCGGCAGGCTCAGCGGGTTTATCACCGTGCTTTCACTTTCCGCTTCACTGGACTCTTCCTTTTC
CTCTTGCATCCGCATACCCCGCGCCACTGGGTCGTCTTCATTCAGCCGCCGCACCGTGCGCTTACCTCCC
TTGCCGTGCTTGATTAGCACCGGTGGGTTGCTGAAACCCACCATTTGTAGCGCCACATCTTCTCTTTCTT
CCTCGCTGTCCACGATCACCTCTGGGGATGGCGGGCGCTCGGGCTTGGGAGAGGGGCGCTTCTTTTTCTT
TTTGGACGCAATGGCCAAATCCGCCGTCGAGGTCGATGGCCGCGGGCTGGGTGTGCGCGGCACCAGCGCA
TCTTGTGACGAGTCTTCTTCGTCCTCGGACTCGAGACGCCGCCTCAGCCGCTTTTTTGGGGCGCGCGGG
GAGGCGGCGGCGACGGCGACGGGGACGAGACGTCCTCCATGGTTGGTGGACGTCGCGCCGCACCGCGTCC
GCGCTCGGGGGTGGTTTCGCGCTGCTCCTCTTCCCGACTGGCCATTTCCTTCTCCTATAGGCAGAAAAAG
ATCATGGAGTCAGTCGAGAAGGAGGACAGCCTAACCGCCCCTTTGAGTTCGCCACCACCGCCTCCACCG
ATGCCGCCAACGCGCCTACCACCTTCCCCGTCGAGGCACCCCGCTTGAGGAGGAGGAAGTGATTATCGA
GCAGGACCCAGGTTTTGTAAGCGAAGACGACGAAGATCGCTCAGTACCAACAGAGGATAAAAAGCAAGAC
CAGGACGACGCAGAGGCAAACGAGGAACAAGTCGGGCGGGGGACCAAAGGCATGGCGACTACCTAGATG
TGGGAGACGACGTGCTGTTGAAGCATCTGCAGCGCCAGTGCGCCATTATCTGCGACGCGTTGCAAGAGCG
CAGCGATGTGCCCCTCGCCATAGCGGATGTCAGCCTTGCCTACGAACGCCACCTGTTCTCACCGCGCGTA
CCCCCAAACGCCAAGAAAACGGCACATGCGAGCCCAACCCGCGCCTCAACTTCTACCCCGTATTTGCCG
TGCCAGAGGTGCTTGCCACCTATCACATCTTTTTCCAAAACTGCAAGATACCCCTATCCTGCCGTGCCAA
CCGCAGCCGAGCGGACAAGCAGCTGGCCTTGCGGCAGGGCGCTGTCATACCTGATATCGCCTCGCTCGAC
GAAGTGCCAAAAATCTTTGAGGGTCTTGGACGCGACGAGAAGCGCGCGGCAAACGCTCTGCAACAAGAAA
ACAGCGAAAATGAAAGTCACTGTGGAGTGCTGGTGGAACTTGAGGGTGACAACGCGCGCCTAGCCGTGCT
GAAACGCAGCATCGAGGTCACCCACTTTGCCTACCGGCACTTAACCTACCCCCAAGGTTATGAGCACA
GTCATGAGCGAGCTGATCGTGCGCCGTGCACGACCCCTGGAGAGGGATGCAAACTTGCAAGAACAAACCG
AGGAGGGCCTACCCGCAGTTGGCGATGAGCAGCTGGCGCGCTGGCTTGAGACGCGCGAGCCTGCCGACTT
GGAGGAGCGACGCAAGCTAATGATGGCCGCAGTGCTTGTTACCGTGGAGCTTGAGTGCATGCAGCGGTTC
TTTGCTGACCCGGAGATGCAGCGCAAGCTAGAGGAAACGTTGCACTACACCTTTCGCCAGGGCTACGTGC
GCCAGGCCTGCAAAATTTCCAACGTGGAGCTCTGCAACCTGGTCTCCTACCTTGGAATTTTGCACGAAAA
CCGCCTTGGGCAAAACGTGCTTCATTCCACGCTCAAGGGCGAGGCGCGCCGCGACTACGTCCGCGACTGC
GTTTACTTATTTCTGTGCTACACCTGGCAAACGGCCATGGGCGTGTGGCAGCAGTGCCTGGAGGAGCGCA
ACCTGAAGGAGCTGCAGAAGCTGCTAAAGCAAAACTTGAAGGACCTATGGACGGCCTTCAACGAGCGCTC
CGTGGCCGCGCACCTGGCGGACATTATCTTCCCCGAACGCCTGCTTAAAACCCTGCAACAGGGTCTGCCA
GACTTCACCAGTCAAAGCATGTTGCAAAACTTTAGGAACTTTATCCTAGAGCGTTCAGGAATTCTGCCCG
CCACCTGCTGTGCGCTTCCTAGCGACTTTGTGCCCATTAAGTACCGTGAATGCCCTCCGCCGCTTTGGGG
TCACTGCTACCTTNTGCAGCTAGCCAACTACCTTGCCTACCACTCCGACATCATGGAAGACGTGAGCGGT
GACGGCCTACTGGAGTGTCACTGTCGCTGCAACCTATGCACCCCGCACCGCTCCCTGGTCTGCAATTCAC
AACTGCTTAGCGAAAGTCAAATTATCGGTACCTTTGAGCTGCAGGGTCCCTCGCCTGACGAAAAGTCCGC
GGCTCCGGGGTTGAAACTCACTCCGGGGCTGTGGACGTCGGCTTACCTTCGCAAATTTGTACCTGAGGAC
TACCACGCCCACGAGATTAGGTTCTACGAAGACCAATCCCGCCCGCCAAATGCGGAGCTTACCGCCTGCG
TCATTACCCAGGGCCACATCCTTGGCCAATTGCAAGCCATTAACAAAGCCCGCCAAGAGTTTCTGCTACG
AAAGGGACGGGGGGTTTACTTGGACCCCCAGTCCGGCGAGGAGCTCAACCCAATCCCCCGCCGCCGCAG
CCCTATCAGCAGCCGCGGGCCCTTGCTTCCCAGGATGGCACCCAAAAAGAAGCTGCAGCTGCCGCCGCCG
CCACCCACGGACGAGGAGGAATACTGGGACAGTCAGGCAGAGGAGGTTTTGGACGAGGAGGAGGAGATGA
TGGAAGACTGGGACAGCCTAGACGAGGAAGCTTCCGAGGCCGAAGAGGTGTCAGACGAAACACCGTCACC
CTCGGTCGCATTCCCCTCGCCGGCGCCCCAGAAATCGGCAACCGTTCCCAGCATTGCTACAACCTCCGCT
CCTCAGGCGCCGCCGGCACTGCCCGTTCGCCGACCCAACCGTAGATGGGACACCACTGGAACCAGGGCCG
GTAAGTCTAAGCAGCCGCCGCCGTTAGCCCAAGAGCAACAACAGCGCCAAGGCTACCGCTCGTGGCGCGT
GCACAAGAACGCCATAGTTGCTTGCTTGCAAGACTGTGGGGCAACATCTCCTTCGCCCGCCGCTTTCTT
CTCTACCATCACGGCGTGGCCTTCCCCCGTAACATCCTGCATTACTACCGTCATCTCTACAGCCCCTACT
GCACCGGCGGCAGCGGCAGCAACAGCAGCGGCCACGCAGAAGCAAAGGCGACCGGATAGCAAGACTCTGA
CAAAGCCCAAGAAATCCACAGCGGCGGCAGCAGCAGGAGGAGGAGCACTGCGTCTGGCGCCCAACGAACC
```

FIG. 61 (continued)

SEQ ID NO:36 (continued)

```
CGTATCGACCCGCGAGCTTAGAAACAGGATTTTTCCCACTCTGTATGCTATATTTCAACAGAGCAGGGGC
CAAGAACAAGAGCTGAAAATAAAAAACAGGTCTCTGCGCTCCCTCACCCGCAGCTGCCTGTATCACAAAA
GCGAAGATCAGCTTCGGCGCACGCTGGAAGACGCGGAGGCTCTCTTCAGCAAATACTGCGCGCTGACTCT
TAAGGACTAGTTTCGCGCCCTTTCTCAAATTTAAGCGCGAAAACTACGTCATCTCCAGCGGCCACACCCG
GCGCCAGCACCTGTCGTCAGCGCCATTATGAGCAAGGAAATTCCCACGCCCTACATGTGGAGTTACCAGC
CACAAATGGGACTTGCGGCTGGAGCTGCCCAAGACTACTCAACCCGAATAAACTACATGAGCGCGGGACC
CCACATGATATCCCGGGTCAACGGAATCCGCGCCCACCGAAACCGAATTCTCCTCGAACAGGCGGCTATT
ACCACCACACCTCGTAATAACCTTAATCCCCGTAGTTGGCCCGCTGCCCTGGTGTACCAGGAAAGTCCCG
CTCCCACCACTGTGGTACTTCCCAGAGACGCCCAGGCCGAAGTTCAGATGACTAACTCAGGGGCGCAGCT
TGCGGGCGGCTTTCGTCACAGGGTGCGGTCGCCCGGGCAGGGTATAACTCACCTGAAAATCAGAGGGCGA
GGTATTCAGCTCAACGACGAGTCGGTGAGCTCCTCTCTTGGTCTCCGTCCGGACGGGACATTTCAGATCG
GCGGCGCTGGCCGCTCTTCATTTACGCCCGTCAGGCGATCCTAACTCTGCAGACCTCGTCCTCGGAGCC
GCGCTCCGGAGGCATTGGAACTCTACAATTTATTGAGGAGTTCGTGCCTTCGGTTTACTTCAACCCCTTT
TCTGGACCTCCCGGCCACTACCCGGACCAGTTTATTCCCAACTTTGACGCGGTAAAAGACTCGGCGGACG
GCTACGACTGACAGATCTGAGCTCGCGGCCGCGATATCGCTAGCGAAGTTCCTATTCTCTAGAAAGTATA
GGAACTTCGATCCTCTAGAGTCGACCTGCAGGCATGCAAGCTTGGCACTGCAATAAATTACTTACTTAAA
ATCAGTCAGCAAATCTTTGTCCAGCTTATTCAGCATCACCTCCTTTCCCTCCTCCCAACTCTGGTATTTC
AGCAGCCTTTTAGCTGCGAACTTTCTCCAAAGTCTAAATGGGATGTCAAATTCCTCATGTTCTTGTCCCT
CCGCACCCACTATCTTCATATTGTTGCAGATGAAACGCGCCAGACCGTCTGAAGACACCTTCAACCCTGT
GTACCCATATGACACGGAAACCGGCCCTCCAACTGTGCCTTTCCTTACCCCTCCCTTTGTGTCGCCAAAT
GGGTTCCAAGAAAGTCCCCCCGGAGTGCTTTCTTTGCGTCTTTCAGAACCTTTGGTTACCTCACACGGCA
TGCTTGCGCTAAAAATGGGCAGCGGCCTGTCCCTGGATCAGGCAGGCAACCTTACATCAAATACAATCAC
TGTTTCTCAACCGCTAAAAAAACAAAGTCCAATATAACTTTGGAAACATCCGCGCCCTTACAGTCAGC
TCAGGCGCCCTAACCATGGCCACAACTTCGCCTTTGGTGGTCTCTGACAACACTCTTACCATGCAATCAC
AAGCACCGCTAACCGTGCAAGACTCAAAACTTAGCATTGCTACCAAAGAGCCACTTACAGTGTTAGATGG
AAAACTGGCCCTGCAGACATCAGCCCCCCTCTCTGCCACTGATAACAACGCCCTCACTATCACTGCCTCA
CCTCCTCTTACTACTGCAAATGGTAGTCTGGCTGTTACCATGGAAAACCCACTTTACAACAACAATGGAA
AACTTGGGCTCAAAATTGGCGGTCCTTTGCAAGTGGCCACCGACTCACATGCACTAACACTAGGTACTGG
TCAGGGGGTTGCAGTTCATAACAATTTGCTACATACAAAAGTTACAGGCGCAATAGGGTTTGATACATCT
GGCAACATGGAACTTAAAACTGGAGATGGCCTCTATGTGGATAGCGCCGGTCCTAACCAAAAACTACATA
TTAATCTAAATACCACAAAAGGCCTTGCTTTTGACAACACCGCAATAACAATTAACGCTGGAAAAGGGTT
GGAATTTGAAACAGACTCCTCAAACGGAAATCCCATAAAAACAAAAATTGGATCAGGCATACAATATAAT
ACCAATGGAGCTATGGTTGCAAAACTTGGAACAGGCCTCAGTTTTGACAGCTCCGGAGCCATAACAATGG
GCAGCATAAACAATGACAGACTTACTCTTTGGACAACACCAGACCCATCCCCAAATTGCAGAATTGCTTC
AGATAAAGACTGCAAGCTAACTCTGGCGCTAACAAAATGTGGCAGTCAAATTTTGGGCACTGTTTCAGCT
TTGGCAGTATCAGGTAATATGGCCTCCATCAATGGAACTCTAAGCAGTGTAAACTTGGTTCTTAGATTTG
ATGACAACGGAGTGCTTATGTCAAATTCATCACTGGACAAACAGTATTGGAACTTTAGAAACGGGGACTC
CACTAACGGTCAACCATACACTTATGCTGTTGGGTTTATGCCAAACCTAAAAGCTTACCCAAAAACTCAA
AGTAAAACTGCAAAAAGTAATATTGTTAGCCAGGTGTATCTTAATGGTGACAAGTCTAAACCATTGCATT
TTACTATTACGCTAAATGGAACAGATGAAACCAACCAAGTAAGCAAATACTCAATATCATTCAGTTGGTC
CTGGAACAGTGGACAATACACTAATGACAAATTTGCCACCAATTCCTATACCTTCTCCTACATTGCCCAG
GAATAAAGAATCGTGAACCTGTTGCATGTTATGTTTCAACGTGTTTATTTTTCAATTCGTATTAGTCATC
GCTATTACCATGGTGATGCGGTTTTGGCAGTACATCAATGGGCGTGGATAGCGGTTTGACTCACGGGAT
TTCCAAGTCTCCACCCCATTGACGTCAATGGGAGTTTGTTTTGGCACCAAAATCAACGGGACTTTCCAAA
ATGTCGTAACAACTCCGCCCCATTGACGCAAATGGGCGGTAGGCGTGTACGGTGGGAGGTCTATATAAGC
AGAGCTGGTTTAGTGAACCGTCAGATCGCTAGAGATCCACCATGTTTGTCTTTCTCGTGCTGCTGCCCC
TCGTGAGCAGCCAGTGCGTCAATCTGACAACAAGGACCCAGCTGCCCCCGCCTACACCAACTCCTTCAC
AAGAGGCGTGTATTACCCCGATAAGGTCTTCAGATCCAGCGTCCTCCACAGCACCCAAGATTTGTTTCTG
CCTTTCTTCAGCAACGTGACATGGTTCCACGCCATTCATGTCAGCGGCACAAACGGCACAAAGAGGTTTG
ACAACCCCGTGCTCCCCTTCAACGACGGCGTGTACTTCGCCAGCACAGAGAAATCCAATATCATTAGGGG
CTGGATCTTCGGCACAACACTGGATTCCAAGACCCAGTCTCTGCTCATTGTGAATAACGCCACCAACGTG
GTGATTAAGGTCTGTGAGTTTCAGTTCTGCAACGACCCCTTTCTGGGAGTCTACTACCACAAGAATAATA
```

SEQ ID NO:36 (continued)

```
AGAGCTGGATGGAGTCCGAGTTTAGGGTGTACAGCTCCGCCAACAACTGTACCTTCGAATACGTGTCCCA
GCCTTTCCTCATGGATCTGGAGGGCAAGCAAGGCAATTTCAAAAATCTGAGAGAGTTCGTGTTCAAAAAC
ATTGATGGATACTTCAAAATCTACAGCAAGCATACCCCCATTAATCTGGTGAGGGATCTGCCCCAAGGAT
TCTCCGCTCTGGAACCTCTGGTGGATCTGCCCATTGGCATTAACATCACAAGATTCCAGACCCTCCTCGC
CCTCCATAGATCCTATCTGACCCCCGGCGACTCCTCCAGCGGATGGACAGCCGGAGCTGCCGCCTACTAC
GTGGGCTATCTGCAGCCAAGAACCTTTCTGCTGAAGTACAACGAGAACGGCACCATCACAGACGCTGTCG
ATTGCGCTCTCGACCCTCTGAGCGAGACCAAATGCACACTGAAGAGCTTCACCGTGGAAAAGGGCATCTA
TCAGACCAGCAACTTCAGAGTGCAGCCTACCGAGAGCATTGTGAGGTTTCCAACATCACCAATCTGTGT
CCTTTCGGCGAGGTCTTTAATGCCACAAGGTTCGCTTCCGTGTATGCTTGGAATAGGAAGAGGATCAGCA
ATTGCGTCGCCGACTATTCCGTCCTCTATAACAGCGCCTCCTTCTCCACCTTCAAATGTTATGGCGTGTC
CCCCACCAAGCTCAACGACCTCTGCTTCACCAATGTGTACGCTGACTCCTTCGTCATTAGGGGCGACGAG
GTGAGGCAAATTGCCCCCGGCCAGACCGGCAAGATTGCTGATTACAACTACAAACTGCCCGACGATTTTA
CCGGCTGCGTGATCGCTTGGAACTCCAACAATCTGGACTCCAAAGTGGGCGGAAACTACAATTACCTCTA
CAGACTCTTTAGAAAAAGCAATCTGAAGCCCTTCGAGAGAGACATCTCCACCGAAATCTACCAAGCCGGA
AGCACACCTTGCAATGGCGTCGAGGGATTTAACTGCTACTTCCCTCTGCAGAGCTACGGCTTTCAACCTA
CCAACGGCGTCGGATATCAACCCTATAGGGTGGTCGTGCTGAGCTTTGAACTGCTGCATGCTCCCGCCAC
CGTCTGCGGACCTAAGAAGAGCACCAATCTCGTCAAAAACAAGTGCGTGAACTTCAACTTCAATGGACTG
ACCGGCACCGGCGTGCTGACCGAGAGCAATAAGAAGTTTCTGCCCTTCCAGCAGTTCGGAAGGGATATTG
CCGATACCACAGATGCTGTGAGGGACCCCCAAACCCTCGAGATTCTGGATATCACCCCTTGCAGCTTCGG
AGGAGTGTCCGTGATCACCCCCGGAACAAACACCTCCAATCAAGTGGCTGTGCTGTACCAAGACGTGAAC
TGCACAGAAGTCCCCGTGGCCATCCATGCCGACCAGCTGACCCCTACATGGAGAGTGTACTCCACCGGCA
GCAATGTGTTCCAGACAAGAGCCGGATGCCTCATTGGAGCTGAACACGTCAACAACAGCTACGAGTGCGA
CATTCCCATCGGCGCCGGCATTTGTGCCTCCTATCAGACCCAGACCAACAGCCCAAGAAGGGCTAGAAGC
GTCGCTTCCCAATCCATCATTGCCTACACCATGTCTCTGGGAGCCGAAAACTCCGTCGCCTACTCCAACA
ATAGCATCGCCATCCCCACCAATTTTACCATCTCCGTGACCACAGAGATTCTGCCCGTGTCCATGACAAA
GACATCCGTGGACTGCACCATGTACATCTGTGGCGACAGCACCGAGTGTAGCAATCTGCTGCTGCAATAT
GGCAGCTTCTGCACCCAGCTGAACAGAGCCCTCACCGGCATCGCCGTCGAACAAGACAAGAACACCCAAG
AGGTGTTCGCCCAAGTGAAGCAAATCTACAAGACCCCCCCTATCAAAGATTTCGGAGGATTCAACTTTAG
CCAGATTCTGCCCGATCCTAGCAAGCCTTCCAAGAGGAGCTTCATCGAGGATCTGCTGTTTAATAAGGTG
ACACTGGCCGACGCTGGCTTCATTAAACAGTACGGCGATTGTCTGGGCGACATCGCTGCTAGGGATCTGA
TCTGCGCTCAGAAGTTCAACGGACTGACAGTCCTCCCTCCTCTGCTGACCGACGAGATGATCGCTCAGTA
TACCAGCGCTCTGCTGGCTGGAACCATTACCAGCGGCTGGACATTCGGCGCTGGAGCCGCCCTCCAAATT
CCCTTTGCCATGCAGATGGCCTATAGATTCAACGGCATTGGCGTCACCCAAAATGTGCTGTATGAAAATC
AGAAGCTGATTGCTAACCAATTCAATAGCGCCATTGGCAAGATCCAAGACTCTCTGAGCTCCACAGCCAG
CGCCCTCGGAAAGCTGCAAGACGTGGTGAATCAAAACGCCCAAGCTCTGAACACACTGGTGAAACAGCTC
AGCAGCAACTTTGGAGCCATCAGCAGCGTGCTCAATGATATCCTCTCTAGGCTGGACAAAGTGGAGGCCG
AAGTCCAGATCGATAGACTCATCACCGGCAGACTCCAATCTCTGCAGACATACGTCACCCAACAGCTCAT
TAGAGCTGCCGAAATCAGAGCCTCCGCCAATCTGGCCGCCACCAAGATGTCCGAGTGCGTGCTGGGACAG
AGCAAGAGAGTGGACTTCTGTGGCAAGGGATACCATCTGATGAGCTTCCCCCAGAGCGCTCCCCATGGAG
TGGTCTTTCTGCATGTCACATACGTGCCCGCCAAGAGAAGAACTTCACCACCGCTCCCGCCATTTGCCA
CGATGGAAAGGCCCACTTTCCCAGAGAAGGAGTGTTCGTGAGCAACGGCACACACTGGTTTGTCACCCAG
AGAAATTTTTACGAGCCCCAGATTATCACCACCGACAACACCTTCGTGTCCGGAAACTGCGATGTCGTGA
TTGGCATCGTGAACAACACAGTCTACGACCCTCTGCAGCCCGAACTCGACAGCTTCAAGGAAGAGCTGGA
CAAGTACTTCAAGAATCACACATCCCCCGACGTGGATCTGGGCGACATTAGCGGCATTAATGCCTCCGTC
GTCAACATTCAGAAGGAGATTGATAGACTGAATGAAGTCGCCAAGAACCTCAATGAGTCTCTGATTGATC
TGCAAGAGCTGGGCAAGTACGAGCAATACATCAAATGGCCTTGGTACATCTGGCTGGGATTCATCGCTGG
ACTCATCGCCATCGTGATGGTCACCATTATGCTGTGTTGCATGACCAGCTGCTGCAGCTGTCTGAAGGGC
TGCTGCAGCTGCGGAAGCTGCTGCAAGTTTGACGAAGACGACTCCGAGCCCGTGCTGAAGGGCGTCAAGC
TGCATTATACATAAACTAGTGCTGGAATTCGCCCTTATAGAGTGCTGGAATTCGCCCTTATAGAGTGCTG
GAATTCGCCCTTATATCTAGTAACGGCCGCCAGTGTGCTGGAATTCGCCCTTATAACTTCGTATAGCATA
CATTATACGAAGTTATAAGGGCGAATTCTGCAGATATCCATCCTTTAAAAAACCTCCCACACCTCCCCCT
GAACCTGAAACATAAAATGAATGCAATTGTTGTTGTTAACTTGTTTATTGCAGCTTATAATGGTTACAAA
```

FIG. 61 (continued)

SEQ ID NO:36 (continued)

```
TAAAGCAATAGCATCACAAATTTCACAAATAAAGCATTTTTTTCACTGCATTCTAGTTGTGGTTTGTCCA
AACTCATCAATGTATCTTAACAACGTGTTTATTTTTCAATTGCAGAAAGAATTGCAGAAAATTTCAAGTC
ATTTTTCATTCAGTAGTATAGCCCCACCACCACATAGCTTATACTAATCACCGTACCTTAATCAAACTCA
CAGAACCCTAGTATTCAACCTGCCACCTCCCTCCCAACACACAGAGTACACAGTCCTTTCTCCCCGGCTG
GCCTTAAACAGCATCATATCATGGGTAACAGACATATTCTTAGGTGTTATATTCCACACGGTCTCCTGTC
GAGCCAAACGCTCATCAGTGATGTTAATAAACTCCCCGGGCAGCTCGCTTAAGTTCATGTCGCTGTCCAG
CTGCTGAGCCACAGGCTGCTGTCCAACTTGCGGTTGCTCAACGGGCGGCGAAGGAGAAGTCCACGCCTAC
ATGGGGGTAGAGTCATAATCGTGCATCAGGATAGGGCGGTGGTGCTGCAGCAGCGCGCGAATAAACTGCT
GCCGCCGCCGCTCCGTCCTGCAGGAATACAACATGGCAGTGGTCTCCTCAGCGATGATTCGCACCGCCCG
CAGCATAAGGCGCCTTGTCCTCCGGGCACAGCAGCGCACCCTGATCTCACTTAAGTCAGCACAGTAACTG
CAGCACAGTACCACAATATTGTTTAAAATCCCACAGTGCAAGGCGCTGTATCCAAAGCTCATGGCGGGGA
CCACAGAACCCACGTGGCCATCATACCACAAGCGCAGGTAGATTAAGTGGCGACCCCTCATAAACACGCT
GGACATAAACATTACCTCTTTTGGCATGTTGTAATTCACCACCTCCCGGTACCATATAAACCTCTGATTA
AACATGGCGCCATCCACCACCATCCTAAACCAGCTGGCCAAAACCTGCCCGCCGGCTATGCACTGCAGGG
AACCGGGACTGGAACAATGACAGTGGAGAGCCCAGGACTCGTAACCATGGATCATCATGCTCGTCATGAT
ATCAATGTTGGCACAACACAGGCACACGTGCATACACTTCCTCAGGATTACAAGCTCCTCCCGCGTCAGA
ACCATATCCCAGGGAACAACCCATTCCTGAATCAGCGTAAATCCCACACTGCAGGGAAGACCTCGCACGT
AACTCACGTTGTGCATTGTCAAAGTGTTACATTCGGGCAGCAGCGGATGATCCTCCAGTATGGTAGCGCG
TGTCTCTGTCTCAAAAGGAGGTAGGCGATCCCTACTGTACGGAGTGCGCCGAGACAACCGAGATCGTGTT
GGTCGTAGTGTCATGCCAAATGGAACGCCGGACGTAGTCATATTTCCTGAAGCAAAACCAGGTGCGGGCG
TGACAAACAGATCTGCGTCTCCGGTCTCGTCGCTAGCTCGCTCTGTGTAGTAGTTGTAGTATATCCACT
CTCTCAAAGCATCCAGGCGCCCCCTGGCTTCGGGTTCTATGTAAACTCCTTCATGCGCCGCTGCCCTGAT
AACATCCACCACCGCAGAATAAGCCACACCCAGCCAACCTACACATTCGTTCTGCGAGTCACACACGGGA
GGAGCGGGAAGAGCTGGAAGAACCATGTTTTTTTTTTTATTCCAAAAGATTATCCAAAACCTCAAAATG
AAGATCTATTAAGTGAACGCGCTCCCCTCCGGTGGCGTGGTCAAACTCTACAGCCAAAGAACAGATAATG
GCATTTGTAAGATGTTGCACAATGGCTTCCAAAAGGCAAACTGCCCTCACGTCCAAGTGGACGTAAAGGC
TAAACCCTTCANGGTGAATCTCCTCTATAAACATTCCAGCACCTTCAACCATGCCCAAATAATTTTCATC
TCGCCACCTTATCAATATGTCTCTAAGCAAATCCCGAATATTAAGTCCGGCCATTGTAAAAATCTGCTCC
AGAGCGCCCTCCACCTTCAGCCTCAAGCAGCGAATCATGATTGCAAAAATTCAGGTTCCTCACAGACCTG
TATAAGATTCAAAAGCGGAACATTAACAAAAATACCGCGATCCCGTAGGTCCCTTCGCAGGGCCAGCTGA
ACATAATCGTGCAGGTCTGCACGGACCAGCGCGGCCACTTCCCGCCAGGAACCATGACAAAAGAACCCA
CACTGATTATGACACGCATACTCGGAGCTATGCTAACCAGCGTAGCCCCGATGTAAGCTTGTTGCATGGG
CGGCGATATAAAATGCAAGGTACTGCTCAAAAAATCAGGCAAAGCCTCGCGCAAAAAAGCAAGCACATCG
TAGTCATGCTCATGCAGATAAAGGCAGGTAAGTTCCGGAACCACCACAGAAAAGACACCATTTTTCTCT
CAAACATGTCTGCGGGTTCCTGCATAAACACAAAATAAAATAACAAAAAAAAAAAAACATTTAAACATTA
GAAGCCTGTCTTACAACAGGAAAAACAACCCTTATAAGCATAAGACGGACTACGGCCATGCCGGCGTGAC
CGTAAAAAAACTGGTCACCGTGATTAAAAAGCACCACCGACAGTTCCTCGGTCATGTCCGGAGTCATAAT
GTAAGACTCGGTAAACACATCAGGTTGGTTAACATCGGTCAGTGCTAAAAAGCGACCGAAATAGCCCGGG
GGAATACATACCCGCAGGCGTAGAGACAACATTACAGCCCCATAGGAGGTATAACAAAATTAATAGGAG
AGAAAAACACATAAACCCCTGAAAAACCCTCCTGCCCCTAGGCAAAATAGCACCCTCCCGCTCCAGAACA
ACATACAGCGCTTCCACAGCGGCAGCCATAACAGTCAGCCTTACCAGTAAAAAAACCTATTAAAAAACAC
CACTCGACACGGCACCAGCTCAATCAGTCACAGTGTAAAAAGGGCCAAGTACAGAGCGAGTATATATAGG
ACTAAAAAATGACGTAACGGTTAAAGTCCACAAAAACCACCCAGAAAACCGCACGCGAACCTACGCCCAG
AAACGAAAGCCAAAAAACCCACAACTTCCTCAAATCTTCACTTCCGTTTTCCCACGATACGTCACTTCCC
ATTTTAAAAAAAAACTACAATTCCCAATACATGCAAGTTACTCCGCCCTAAAACCTACGTCACCCGCCCC
GTTCCCACGCCCCGCGCCACGTCACAAACTCCACCCCCTCATTATCATATTGGCTTCAATCCAAAATAAG
GTATATTATTGATGATGGCGAT
```

FIG. 61 (continued)

SEQ ID NO:37

```
CGCCATCATCAATAATATACCTTATTTTGGATTGAAGCCAATATGATAATGAGGGGGTGGAGTTTGTGAC
GTGGCGCGGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTTACGTGGAGACTCGCCCAGGTGTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGGTAAAGAGGGAGCGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGTGGTTATTATGA
ATGTGAGGTTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGGTGGTGTGTCGCCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC
GCACCAGGTGCAGACCCTGCGAGTGTGGCGGTAAACATATTAGGAACCAGCCTGTGATGCTGGATGTGAC
```

FIG. 62

SEQ ID NO:37 (continued)

```
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGGATATGAG
ATGCATCTTGGACTGTATTTTTAGGTTGGCTATGTTCCCAGCCATATCCCTCCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGGATCATGTCTACCTG
CGGGGCGATGAAGAAAACCGTTTCCGGGGTAGGGGAGATCAGCTGGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGCCACTTCGTTAAGCATGTCCCTGACTTGCATGTTTTCCCT
GACCAAATCCGCCAGAAGGCGCTCGCCGCCCAGCGATAGCAGTTCTTGCAAGGAAGCAAAGTTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGGCGCCGCACGAGGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCTGGTCAGAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGACCCCATGGCATGGGTGGGTGAGCGCGGAGGCG
TACATGCCGCAAATGTCGTAAACGTAGAGGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
CGCGCAGCTTGTTGACCAGCTCGGCGGTGACCTGCACGTCTAGGGCGCAGTAGTCCAGGGTTTCCTTGAT
```

SEQ ID NO:37 (continued)

```
GATGTCATACTTATCCTGTCCCTTTTTTTTCCACAGCTCGCGGTTGAGGACAAACTCTTCGCGGTCTTTC
CAGTACTCTTGGATCGGAAACCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAAGTCCGTGCGCTTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCCGCGGCGCGACTACGGTACCGCGCGG
CGGGCGGTGGGCCGCGGGGTGTCCTTGGATGATGCATCTAAAAGCGGTGACGCGGGCGGGCCCCCGGAG
GTAGGGGGGGCTCGGGACCCGCCGGGAGAGGGGGCAGGGGCACGTCGGCGCCGCGCGGGCAGGAGCTG
GTGCTGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCCAAGGCCTCAAGGCGCTCCATGGCCTCGTAGAAGTCCACGG
CGAAGTTGAAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGGCCTCTTCTTCTTCTTCAATCTCCTCTTCCATA
AGGGCCTCCCCTTCTTCTTCTTCTGGCGGCGGTGGGGAGGGGGGACACGGCGGCGACGACGGCGCACCG
GGAGGCGGTCGACAAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAAGTGCGGCGGCGG
CTGGCGGTAGAGGGCCAGCGTAGGGTGGCCGGGCTCCGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
TAAATTCGCAAGGGTATCATGGCGGACGACCGGGGTTCGAACCCCGGATCCGGCCGTCCGCCGTGATCCA
```

SEQ ID NO:37 (continued)

```
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGTTTGACCCCGTCACTGGTCTTGTCATGCCTGGGGTATATA
CAAACGAAGCCTTCCATCCAGACATCATTTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCCGGTGGTGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTTGGCGCGCCCGCCAGCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GGCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
ACACCCAGTGCGCGTGCGCGGGCACTACCGCGCGCCCTGGGGCGCGCACAAACGCGGCCGCACTGGGCGC
```

FIG. 62 (continued)

SEQ ID NO:37 (continued)

ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAAGAAGAGATGCTCCAGGTCATCGCGCCGGAGATCTA
TGGCCCCCCGAAGAAGGAAGAGCAGGATTACAAGCCCGAAAGCTAAAGCGGGTCAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCGGCGTCCGCGCCGTTCAAGGAAGTACGGCGCCGCCAGCGCGCTACTGCCCGAATATGCCCT
ACATCCTTCCATCGCGCCTACCCCGGCTATCGTGGCTACACCTACCGCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAATAAAAGTCTGGACTCTCACGCTCGCTTGGTCCTGTAACTATTTT
GTAGAATGGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CCGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTCTGGGGTGCAATCCCTGAAGCGCCGACGATGCTTCTGATCGCGGCCGCGA
TATCGCTAGCGAATTCGAAGTTCCTATTCTCTAGAAAGTATAGGAACTTCGGATCCTCTAGAGTCGATAG
CTAACGTGTCGTATGTGTGTCATGTATGCGTCCATGTCGCCGCCAGAGGAGCTGCTGAGCCGCCGCGCGC
CCGCTTTCCAAGATGGCTACCCCTTCGATGATGCCGCAGTGGTCTTACATGCACATCTCGGGCCAGGACG
CCTCGGAGTACCTGAGCCCCGGCTGGTGCAGTTTGCCCGCGCCACCGAGACGTACTTCAGCCTGAATAA
CAAGTTTAGAAACCCCACGGTGGCGCCTACGCACGACGTGACCACAGACCGGTCCCAGCGTTTGACGCTG
CGGTTCATCCCTGTGGACCGTGAGGATACTGCGTACTCGTACAAGGCGCGGTTCACCCTAGCTGTGGGTG
ATAACCGTGTGCTGGACATGGCTTCCACGTACTTTGACATCCGCGGCGTGCTGGACAGGGGCCCCACTTT
TAAGCCCTACTCCGGCACTGCCTACAACGCCCTAGCTCCCAAGGGTGCCCCCAACTCATGCGAGTGGGAT
GAAGATGATACTCAGGTACAGGTAGCGGCTGAAGACGATCAAGACGACGACGAAGAAGAGGAACAACTAC
CTCAGCAGAGAAATGGCAAAAAACTCACGTATATGCTCAGGCACCGTTTGCTGGCGAAGCAATTAACAA
AAACGGCCTGCAGATAGGAACTAACGGTGCAGCCACTGAAGGAAATAAGGAAATTTACGCAGATAAAACT
TATCAACCTGAACCACAAATAGGAGAATCACAGTGGAACGAAGCCGAATCGTCCGTAGCAGGTGGAAGGG
TTCTTAAAAGACTACTCCCATGAAACCATGCTATGGCTCCTATGCCAGACCTACCAATTCTAACGGAGG

SEQ ID NO:37 (continued)

```
TCAGGGCGTTATGGTTGAACAAAATGGTAAATTGGAAAGTCAAGTAGAAATGCAATTTTTTTCAACTTCT
GTAAATGCTATGAACGAGGCAAACGCTATTCAACCTAAACTAGTGTTGTATAGTGAAGATGTAAATATGG
AAACCCCAGACACTCATCTTTCTTATAAGCCTGGAAAAAGTGATGATAATTCTAAGGCAATGTTGGGTCA
ACAATCTATGCCAAACAGACCCAATTACATAGCTTTCAGGGACAATTTTATTGGCCTAATGTATTACAAC
AGCACTGGTAACATGGGTGTTCTTGCTGGTCAGGCATCACAGCTAAATGCTGTCGTAGATTTGCAAGACA
GAAACACAGAGCTGTCCTACCAACTTTTGCTTGATTCTATTGGTGATCGAACCAGATACTTTTCCATGTG
GAATCAGGCTGTAGACAGCTACGATCCAGATGTTAGAATTATCGAGAACCATGGAACTGAGGATGAATTG
CCAAATTATTGTTTTCCTCTTGGCGGAATTGGGGTGACGGACACCTATCAAGCTATTAAGGCTACAAATG
GAAATGGAGGCGCCACTACCTGGGCTCAGGACAATACTTTTGCAGAACGAAATGAAATAGGGGTGGGAAA
TAACTTTGCCATGGAAATTAACCTGAATGCCAACCTATGGAGAAATTTCCTTTACTCCAATATTGCGCTG
TACCTGCCAGACAAGCTAAATACAACCCCACCAATGTGGAAATATCTGACAATCCCAACACCTACGACT
ACATGAACAAGCGAGTGGTGGCTCCGGGCTGGTGGATTGCTACATTAACCTTGGGGCGCGCTGGTCTCT
GGACTACATGGACAACGTTAATCCCTTTAACCACCACCGCAATGCGGGCCTGCGTTACCGCTCCATGTTG
TTGGGAAACGGCCGCTACGTGCCCTTTCACATTCAGGTGCCCCAAAAGTTTTTTGCCATTAAAAACCTCC
TCCTCCTGCCAGGCTCATACACATATGAATGGAACTTCAGGAAGGATGTTAACATGGTTCTGCAGAGCTC
TCTGGGAAACGACCTTAGAGTTGACGGGGCTAGCATTAAGTTTGACAGCATTTGTCTTTACGCCACCTTC
TTCCCCATGGCCCACAACACGGCCTCCACGCTGGAAGCCATGCTCAGAAATGACACCAACGACCAGTCCT
TTAATGACTACCTTTCCGCCGCCAACATGCTATATCCCATACCCGCCAACGCCACCAACGTGCCCATCTC
CATCCCATCGCGCAACTGGGCAGCATTTCGCGGTTGGGCCTTCACACGCTTGAAGACAAAGGAAACCCCT
TCCCTGGGATCAGGCTACGACCCTTACTACACCTACTCTGGCTCCATACCATACCTTGACGGAACCTTCT
ATCTTAATCACACCTTTAAGAAGGTGGCCATTACTTTTGACTCTTCTGTTAGCTGGCCGGGCAACGACCG
CCTGCTTACTCCCAATGAGTTTGAGATTAAGCGCTCAGTTGACGGGGAGGGCTATAACGTAGCTCAGTGC
AACATGACAAAGGACTGGTTCCTAGTGCAGATGTTGGCCAACTACAATATTGGCTACCAGGGCTTCTACA
TTCCAGAAAGCTACAAAGACCGCATGTACTCGTTCTTCAGAAACTTCCAGCCCATGAGCCGGCAAGTGGT
GGACGATACTAAATACAAAGATTATCAGCAGGTTGGAATTATCCACCAGCATAACAACTCAGGCTTCGTA
GGCTACCTCGCTCCCACCATGCGCGAGGGACAAGCTTACCCCGCTAATGTTCCCTACCCACTAATAGGCA
AAACCGCGGTTGATAGTATTACCCAGAAAAAGTTTCTTTGCGACCGCACCCTGTGGCGCATCCCCTTCTC
CAGTAACTTTATGTCCATGGGTGCGCTCACAGACCTGGGCCAAAACCTTCTCTACGCAAACTCCGCCCAC
GCGCTAGACATGACCTTTGAGGTGGATCCCATGGACGAGCCCACCCTTCTTTATGTTTTGTTTGAAGTCT
TTGACGTGGTCCGTGTGCACCAGCCGCACCGCGGCGTCATCGAGACCGTGTACCTGCGCACGCCCTTCTC
GGCCGGCAACGCCACAACATAAAGAAGCAAGCAACATCAACAACAGCTGCCGCCATGGGCTCCAGTGAGC
AGGAACTGAAAGCCATTGTCAAAGATCTTGGTTGTGGGCCATATTTTTGGGCACCTATGACAAGCGCTT
CCCAGGCTTTGTTTCCCCACACAAGCTCGCCTGCGCCATAGTTAACACGGCCGGTCGCGAGACTGGGGGC
GTACACTGGATGGCCTTTGCCTGGAACCCGCGCTCAAAAACATGCTACCTCTTTGAGCCCTTTGGCTTTT
CTGACCAACGTCTCAAGCAGGTTTACCAGTTTGAGTACGAGTCACTCCTGCGCCGTAGCGCCATTGCCTC
TTCCCCCGACCGCTGTATAACGCTGGAAAAGTCCACCCAAAGCGTGCAGGGGCCCAACTCGGCCGCCTGT
GGCCTATTCTGCTGCATGTTTCTCCACGCCTTTGCCAACTGGCCCCAAACTCCCATGGATCACAACCCCA
CCATGAACCTTATTACCGGGGTACCCAACTCCATGCTTAACAGTCCCCAGGTACAGCCCACCCTGCGCCG
CAACCAGGAACAGCTCTACAGCTTCCTGGAGCGCCACTCGCCCTACTTCCGCAGCCACAGTGCGCAAATT
AGGAGCGCCACTTCTTTTTGTCACTTGAAAAACATGTAAAAATAATGTACTAGGAGACACTTTCAATAAA
GGCAAATGTTTTATTTGTACACTCTCGGGTGATTATTTACCCCCACCCTTGCCGTCTGCGCCGTTTAAA
AATCAAAGGGGTTCTGCCGCGCATCGCTATGCGCCACTGGCAGGGACACGTTGCGATACTGGTGTTTAGT
GCTCCACTTAAACTCAGGCACAACCATCCGCGGCAGCTCGGTGAAGTTTTCACTCCACAGGCTGCGCACC
ATCACCAACGCGTTTAGCAGGTCGGGCGCCGATATCTTGAAGTCGCAGTTGGGGCCTCCGCCCTGCGCGC
GCGAGTTGCGATACACAGGGTTACAGCACTGGAACACTATCAGCGCCGGTGGTGCACGCTGGCCAGCAC
GCTCTTGTCGGAGATCANATCCGCGTCCAGGTCCTCCGCGTTGCTCAGGGCGAACGGAGTCAACTTTGGT
AGCTGCCTTCCCAAAAAGGGTGCATGCCCAGGCTTTGAGTTGCACTCGCACCGTAGTGGCATCAGAAGGT
GACCGTGCCCAGTCTGGGCGTTAGGATACAGCGCCTGCATGAAAGCCTTGATCTGCTTAAAAGCCACCTG
AGCCTTTGCGCCTTCAGAGAAGAACATGCCGCAAGACTTGCCGGAAAACTGATTGGCCGGACAGGCCGCG
TCATGCACGCAGCACCTTGCGTCGGTGTTGGAGATCTGCACCACATTTCGGCCCACCGGTTCTTCACGA
TCTTGGCCTTGCTAGACTGCTCCTTCAGCGCGCGCTGCCCGTTTTCGCTCGTCACATCCATTTCAATCAC
GTGCTCCTTATTTATCATAATGCTCCCGTGTAGACACTTAAGCTCGCCTTCGATCTCAGCGCAGCGGTGC
```

FIG. 62 (continued)

SEQ ID NO:37 (continued)

```
AGCCACAACGCGCAGCCCGTGGGCTCGTGGTGCTTGTAGGTTACCTCTGCAAACGACTGCAGGTACGCCT
GCAGGAATCGCCCCATCATCGTCACAAAGGTCTTGTTGCTGGTGAAGGTCAGCTGCAACCCGCGGTGCTC
CTCGTTTAGCCAGGTCTTGCATACGGCCGCCAGAGCTTCCACTTGGTCAGGCAGTAGCTTGAAGTTTGCC
TTTAGATCGTTATCCACGTGGTACTTGTCCATCAACGCGCGCGCAGCCTCCATGCCCTTCTCCCACGCAG
ACACGATCGGCAGGCTCAGCGGGTTTATCACCGTGCTTTCACTTTCCGCTTCACTGGACTCTTCCTTTTC
CTCTTGCATCCGCATACCCCGCGCCACTGGGTCGTCTTCATTCAGCCGCCGCACCGTGCGCTTACCTCCC
TTGCCGTGCTTGATTAGCACCGGTGGGTTGCTGAAACCCACCATTTGTAGCGCCACATCTTCTCTTTCTT
CCTCGCTGTCCACGATCACCTCTGGGGATGGCGGGCGCTCGGGCTTGGGAGAGGGGCGCTTCTTTTTCTT
TTTGGACGCAATGGCCAAATCCGCCGTCGAGGTCGATGGCCGCGGGCTGGGTGTGCGCGGCACCAGCGCA
TCTTGTGACGAGTCTTCTTCGTCCTCGGACTCGAGACGCCGCCTCAGCCGCTTTTTGGGGCGCGCGGG
GAGGCGGCGGCGACGGCGACGGGGACGAGACGTCCTCCATGGTTGGTGGACGTCGCGCCGCACCGCGTCC
GCGCTCGGGGGTGGTTTCGCGCTGCTCCTCTTCCCGACTGGCCATTTCCTTCTCCTATAGGCAGAAAAAG
ATCATGGAGTCAGTCGAGAAGGAGGACAGCCTAACCGCCCCTTTGAGTTCGCCACCACCGCCTCCACCG
ATGCCGCCAACGCGCCTACCACCTTCCCCGTCGAGGCACCCCGCTTGAGGAGGAGGAAGTGATTATCGA
GCAGGACCCAGGTTTTGTAAGCGAAGACGACGAAGATCGCTCAGTACCAACAGAGGATAAAAAGCAAGAC
CAGGACGACGCAGAGGCAAACGAGGAACAAGTCGGGCGGGGGGACCAAAGGCATGGCGACTACCTAGATG
TGGGAGACGACGTGCTGTTGAAGCATCTGCAGCGCCAGTGCGCCATTATCTGCGACGCGTTGCAAGAGCG
CAGCGATGTGCCCCTCGCCATAGCGGATGTCAGCCTTGCCTACGAACGCCACCTGTTCTCACCGCGCGTA
CCCCCAAACGCCAAGAAAACGGCACATGCGAGCCCAACCCGCGCCTCAACTTCTACCCCGTATTTGCCG
TGCCAGAGGTGCTTGCCACCTATCACATCTTTTTCCAAAACTGCAAGATACCCCTATCCTGCCGTGCCAA
CCGCAGCCGAGCGGACAAGCAGCTGGCCTTGCGGCAGGGCGCTGTCATACCTGATATCGCCTCGCTCGAC
GAAGTGCCAAAAATCTTTGAGGGTCTTGGACGCGACGAGAAGCGCGCGGCAAACGCTCTGCAACAAGAAA
ACAGCGAAAATGAAAGTCACTGTGGAGTGCTGGTGGAACTTGAGGGTGACAACGCGCGCCTAGCCGTGCT
GAAACGCAGCATCGAGGTCACCCACTTTGCCTACCCGGCACTTAACCTACCCCCAAGGTTATGAGCACA
GTCATGAGCGAGCTGATCGTGCGCCGTGCACGACCCTGGAGAGGGATGCAAACTTGCAAGAACAAACCG
AGGAGGGCCTACCCGCAGTTGGCGATGAGCAGCTGGCGCGCTGGCTTGAGACGCGCGAGCCTGCCGACTT
GGAGGAGCGACGCAAGCTAATGATGGCCGCAGTGCTTGTTACCGTGGAGCTTGAGTGCATGCAGCGGTTC
TTTGCTGACCCGGAGATGCAGCGCAAGCTAGAGGAAACGTTGCACTACACCTTTCGCCAGGGCTACGTGC
GCCAGGCCTGCAAAATTTCCAACGTGGAGCTCTGCAACCTGGTCTCCTACCTTGGAATTTTGCACGAAAA
CCGCCTTGGGCAAAACGTGCTTCATTCCACGCTCAAGGGCGAGGCGCGCCGCGACTACGTCCGCGACTGC
GTTTACTTATTTCTGTGCTACACCTGGCAAACGGCCATGGGCGTGTGGCAGCAGTGCCTGGAGGAGCGCA
ACCTGAAGGAGCTGCAGAAGCTGCTAAAGCAAAACTTGAAGGACCTATGGACGGCCTTCAACGAGCGCTC
CGTGGCCGCGCACCTGGCGGACATTATCTTCCCCGAACGCCTGCTTAAAACCCTGCAACAGGGTCTGCCA
GACTTCACCAGTCAAAGCATGTTGCAAAACTTTAGGAACTTTATCCTAGAGCGTTCAGGAATTCTGCCCG
CCACCTGCTGTGCGCTTCCTAGCGACTTTGTGCCCATTAAGTACCGTGAATGCCCTCCGCCGCTTTGGGG
TCACTGCTACCTTNTGCAGCTAGCCAACTACCTTGCCTACCACTCCGACATCATGGAAGACGTGAGCGGT
GACGGCCTACTGGAGTGTCACTGTCGCTGCAACCTATGCACCCCGCACCGCTCCCTGGTCTGCAATTCAC
AACTGCTTAGCGAAAGTCAAATTATCGGTACCTTTGAGCTGCAGGGTCCCTCGCCTGACGAAAGTCCGC
GGCTCCGGGGTTGAAACTCACTCCGGGGCTGTGGACGTCGGCTTACCTTCGCAAATTTGTACCTGAGGAC
TACCACGCCCACGAGATTAGGTTCTACGAAGACCAATCCCGCCCGCCAAATGCGGAGCTTACCGCCTGCG
TCATTACCCAGGGCCACATCCTTGGCCAATTGCAAGCCATTAACAAAGCCCGCCAAGAGTTTCTGCTACG
AAAGGGACGGGGGGTTTACTTGGACCCCCAGTCCGGCGAGGAGCTCAACCCAATCCCCCGCCGCCGCAG
CCCTATCAGCAGCCGCGGGCCCTTGCTTCCCAGGATGGCACCCAAAAAGAAGCTGCAGCTGCCGCCGCCG
CCACCCACGGACGAGGAGGAATACTGGGACAGTCAGGCAGAGGAGGTTTTGGACGAGGAGGAGGAGATGA
TGGAAGACTGGGACAGCCTAGACGAGGAAGCTTCCGAGGCCGAAGAGGTGTCAGACGAAACACCGTCACC
CTCGGTCGCATTCCCCTCGCCGGCGCCCCAGAAATCGGCAACCGTTCCCAGCATTGCTACAACCTCCGCT
CCTCAGGCGCCGCCGGCACTGCCCGTTCGCCGACCCAACCGTAGATGGGACACCACTGGAACCAGGGCCG
GTAAGTCTAAGCAGCCGCCGCCGTTAGCCCAAGAGCAACAACAGCGCCAAGGCTACCGCTCGTGGCGCGT
GCACAAGAACGCCATAGTTGCTTGCTTGCAAGACTGTGGGGCAACATCTCCTTCGCCCGCCGCTTTCTT
CTCTACCATCACGGCGTGGCCTTCCCCCGTAACATCCTGCATTACTACCGTCATCTCTACAGCCCCTACT
GCACCGGCGGCAGCGGCAGCAACAGCAGCGGCCACGCAGAAGCAAAGGCGACCGGATAGCAAGACTCTGA
CAAAGCCCAAGAAATCCACAGCGGCGGCAGCAGCAGGAGGAGGAGCACTGCGTCTGGCGCCCAACGAACC
```

FIG. 62 (continued)

SEQ ID NO:37 (continued)

```
CGTATCGACCCGCGAGCTTAGAAACAGGATTTTTCCCACTCTGTATGCTATATTTCAACAGAGCAGGGGC
CAAGAACAAGAGCTGAAAATAAAAAACAGGTCTCTGCGCTCCCTCACCCGCAGCTGCCTGTATCACAAAA
GCGAAGATCAGCTTCGGCGCACGCTGGAAGACGCGGAGGCTCTCTTCAGCAAATACTGCGCGCTGACTCT
TAAGGACTAGTTTCGCGCCCTTTCTCAAATTTAAGCGCGAAAACTACGTCATCTCCAGCGGCCACACCCG
GCGCCAGCACCTGTCGTCAGCGCCATTATGAGCAAGGAAATTCCCACGCCCTACATGTGGAGTTACCAGC
CACAAATGGGACTTGCGGCTGGAGCTGCCCAAGACTACTCAACCCGAATAAACTACATGAGCGCGGGACC
CCACATGATATCCCGGGTCAACGGAATCCGCGCCCACCGAAACCGAATTCTCCTCGAACAGGCGGCTATT
ACCACCACACCTCGTAATAACCTTAATCCCCGTAGTTGGCCCGCTGCCCTGGTGTACCAGGAAAGTCCCG
CTCCCACCACTGTGGTACTTCCCAGAGACGCCCAGGCCGAAGTTCAGATGACTAACTCAGGGGCGCAGCT
TGCGGGCGGCTTTCGTCACAGGGTGCGGTCGCCCGGGCAGGGTATAACTCACCTGAAAATCAGAGGGCGA
GGTATTCAGCTCAACGACGAGTCGGTGAGCTCCTCTCTTGGTCTCCGTCCGGACGGGACATTTCAGATCG
GCGGCGCTGGCCGCTCTTCATTTACGCCCCGTCAGGCGATCCTAACTCTGCAGACCTCGTCCTCGGAGCC
GCGCTCCGGAGGCATTGGAACTCTACAATTTATTGAGGAGTTCGTGCCTTCGGTTTACTTCAACCCCTTT
TCTGGACCTCCCGGCCACTACCCGGACCAGTTTATTCCCAACTTTGACGCGGTAAAAGACTCGGCGGACG
GCTACGACTGACAGATCTGAGCTCGCGGCCGCGATATCGCTAGCGAAGTTCCTATTCTCTAGAAAGTATA
GGAACTTCGATCCTCTAGAGTCGACCTGCAGGCATGCAAGCTTGGCACTGCAATAAATTACTTACTTAAA
ATCAGTCAGCAAATCTTTGTCCAGCTTATTCAGCATCACCTCCTTTCCCTCCTCCCAACTCTGGTATTTC
AGCAGCCTTTTAGCTGCGAACTTTCTCCAAAGTCTAAATGGGATGTCAAATTCCTCATGTTCTTGTCCCT
CCGCACCCACTATCTTCATATTGTTGCAGATGAAACGCGCCAGACCGTCTGAAGACACCTTCAACCCTGT
GTACCCATATGACACGGAAACCGGCCCTCCAACTGTGCCTTTCCTTACCCCTCCCTTTGTGTCGCCAAAT
GGGTTCCAAGAAAGTCCCCCCGGAGTGCTTTCTTTGCGTCTTTCAGAACCTTTGGTTACCTCACACGGCA
TGCTTGCGCTAAAAATGGGCAGCGGCCTGTCCCTGGATCAGGCAGGCAACCTTACATCAAATACAATCAC
TGTTTCTCAACCGCTAAAAAAACAAAGTCCAATATAACTTTGGAAACATCCGCGCCCTTACAGTCAGC
TCAGGCGCCCTAACCATGGCCACAACTTCGCCTTTGGTGGTCTCTGACAACACTCTTACCATGCAATCAC
AAGCACCGCTAACCGTGCAAGACTCAAAACTTAGCATTGCTACCAAAGAGCCACTTACAGTGTTAGATGG
AAAACTGGCCCTGCAGACATCAGCCCCCCTCTCTGCCACTGATAACAACGCCCTCACTATCACTGCCTCA
CCTCCTCTTACTACTGCAAATGGTAGTCTGGCTGTTACCATGGAAAACCCACTTTACAACAACAATGGAA
AACTTGGGCTCAAAATTGGCGGTCCTTTGCAAGTGGCCACCGACTCACATGCACTAACACTAGGTACTGG
TCAGGGGGTTGCAGTTCATAACAATTTGCTACATACAAAAGTTACAGGCGCAATAGGGTTTGATACATCT
GGCAACATGGAACTTAAAACTGGAGATGGCCTCTATGTGGATAGCGCCGGTCCTAACCAAAAACTACATA
TTAATCTAAATACCACAAAAGGCCTTGCTTTTGACAACACCGCAATAACAATTAACGCTGGAAAAGGGTT
GGAATTTGAAACAGACTCCTCAAACGGAAATCCCATAAAAACAAAAATTGGATCAGGCATACAATATAAT
ACCAATGGAGCTATGGTTGCAAAACTTGGAACAGGCCTCAGTTTTGACAGCTCCGGAGCCATAACAATGG
GCAGCATAAACAATGACAGACTTACTCTTTGGACAACACCAGACCCATCCCCAAATTGCAGAATTGCTTC
AGATAAAGACTGCAAGCTAACTCTGGCGCTAACAAAATGTGGCAGTCAAATTTTGGGCACTGTTTCAGCT
TTGGCAGTATCAGGTAATATGGCCTCCATCAATGGAACTCTAAGCAGTGTAAACTTGGTTCTTAGATTTG
ATGACAACGGAGTGCTTATGTCAAATTCATCACTGGACAAACAGTATTGGAACTTTAGAAACGGGGACTC
CACTAACGGTCAACCATACACTTATGCTGTTGGGTTTATGCCAAACCTAAAAGCTTACCCAAAAACTCAA
AGTAAAACTGCAAAAAGTAATATTGTTAGCCAGGTGTATCTTAATGGTGACAAGTCTAAACCATTGCATT
TTACTATTACGCTAAATGGAACAGATGAAACCAACCAAGTAAGCAAATACTCAATATCATTCAGTTGGTC
CTGGAACAGTGGACAATACACTAATGACAAATTTGCCACCAATTCCTATACCTTCTCCTACATTGCCCAG
GAATAAAGAATCGTGAACCTGTTGCATGTTATGTTTCAACGTGTTTATTTTTCAATTCGTATTAGTCATC
GCTATTACCATGGTGATGCGGTTTTGGCAGTACATCAATGGGCGTGGATAGCGGTTTGACTCACGGGGAT
TTCCAAGTCTCCACCCCATTGACGTCAATGGGAGTTTGTTTTGGCACCAAAATCAACGGGACTTTCCAAA
ATGTCGTAACAACTCCGCCCCATTGACGCAAATGGGCGGTAGGCGTGTACGGTGGGAGGTCTATATAAGC
AGAGCTGGTTTAGTGAACCGTCAGATCCGCTAGAGATCCACCATGTTTGTCTTTCTCGTGCTGCTGCCCC
TCGTGAGCAGCCAGTGCGTCAATCTGACAACAAGGACCCAGCTGCCCCCGCCTACACCAACTCCTTCAC
AAGAGGCGTGTATTACCCCGATAAGGTCTTCAGATCCAGCGTCCTCCACAGCACCCAAGATTTGTTTCTG
CCTTTCTTCAGCAACGTGACATGGTTCCACGCCATTCATGTCAGCGGCACAAACGGCACAAAGAGGTTTG
ACAACCCCGTGCTCCCCTTCAACGACGGCGTGTACTTCGCCAGCACAGAGAAATCCAATATCATTAGGGG
CTGGATCTTCGGCACAACACTGGATTCCAAGACCCAGTCTCTGCTCATTGTGAATAACGCCACCAACGTG
GTGATTAAGGTCTGTGAGTTTCAGTTCTGCAACGACCCCTTTCTGGGAGTCTACTACCACAAGAATAATA
```

SEQ ID NO:37 (continued)

```
AGAGCTGGATGGAGTCCGAGTTTAGGGTGTACAGCTCCGCCAACAACTGTACCTTCGAATACGTGTCCCA
GCCTTTCCTCATGGATCTGGAGGGCAAGCAAGGCAATTTCAAAAATCTGAGAGAGTTCGTGTTCAAAAAC
ATTGATGGATACTTCAAAATCTACAGCAAGCATACCCCCATTAATCTGGTGAGGGATCTGCCCCAAGGAT
TCTCCGCTCTGGAACCTCTGGTGGATCTGCCCATTGGCATTAACATCACAAGATTCCAGACCCTCCTCGC
CCTCCATAGATCCTATCTGACCCCCGGCGACTCCTCCAGCGGATGGACAGCCGGAGCTGCCGCCTACTAC
GTGGGCTATCTGCAGCCAAGAACCTTTCTGCTGAAGTACAACGAGAACGGCACCATCACAGACGCTGTCG
ATTGCGCTCTCGACCCTCTGAGCGAGACCAAATGCACACTGAAGAGCTTCACCGTGGAAAAGGGCATCTA
TCAGACCAGCAACTTCAGAGTGCAGCCTACCGAGAGCATTGTGAGGTTTCCAACATCACCAATCTGTGT
CCTTTCGGCGAGGTCTTTAATGCCACAAGGTTCGCTTCCGTGTATGCTTGGAATAGGAAGAGGATCAGCA
ATTGCGTCGCCGACTATTCCGTCCTCTATAACAGCGCCTCCTTCTCCACCTTCAAATGTTATGGCGTGTC
CCCCACCAAGCTCAACGACCTCTGCTTCACCAATGTGTACGCTGACTCCTTCGTCATTAGGGGCGACGAG
GTGAGGCAAATTGCCCCCGGCCAGACCGGCAAGATTGCTGATTACAACTACAAACTGCCCGACGATTTTA
CCGGCTGCGTGATCGCTTGGAACTCCAACAATCTGGACTCCAAAGTGGGCGGAAACTACAATTACCTCTA
CAGACTCTTTAGAAAAGCAATCTGAAGCCCTTCGAGAGAGACATCTCCACCGAAATCTACCAAGCCGGA
AGCACACCTTGCAATGGCGTCGAGGGATTTAACTGCTACTTCCCTCTGCAGAGCTACGGCTTTCAACCTA
CCAACGGCGTCGGATATCAACCCTATAGGGTGGTCGTGCTGAGCTTTGAACTGCTGCATGCTCCCGCCAC
CGTCTGCGGACCTAAGAAGAGCACCAATCTCGTCAAAAACAAGTGCGTGAACTTCAACTTCAATGGACTG
ACCGGCACCGGCGTGCTGACCGAGAGCAATAAGAAGTTTCTGCCCTTCCAGCAGTTCGGAAGGGATATTG
CCGATACCACAGATGCTGTGAGGGACCCCCAAACCCTCGAGATTCTGGATATCACCCCTTGCAGCTTCGG
AGGAGTGTCCGTGATCACCCCCGGAACAAACACCTCCAATCAAGTGGCTGTGCTGTACCAAGACGTGAAC
TGCACAGAAGTCCCCGTGGCCATCCATGCCGACCAGCTGACCCCTACATGGAGAGTGTACTCCACCGGCA
GCAATGTGTTCCAGACAAGAGCCGGATGCCTCATTGGAGCTGAACACGTCAACAACAGCTACGAGTGCGA
CATTCCCATCGGCGCCGGCATTTGTGCCTCCTATCAGACCCAGACCAACAGCCCAAGAAGGGCTAGAAGC
GTCGCTTCCCAATCCATCATTGCCTACACCATGTCTCTGGGAGCCGAAAACTCCGTCGCCTACTCCAACA
ATAGCATCGCCATCCCCACCAATTTTACCATCTCCGTGACCACAGAGATTCTGCCCGTGTCCATGACAAA
GACATCCGTGGACTGCACCATGTACATCTGTGGCGACAGCACCGAGTGTAGCAATCTGCTGCTGCAATAT
GGCAGCTTCTGCACCCAGCTGAACAGAGCCCTCACCGGCATCGCCGTCGAACAAGACAAGAACACCCAAG
AGGTGTTCGCCCAAGTGAAGCAAATCTACAAGACCCCCCCTATCAAAGATTTCGGAGGATTCAACTTTAG
CCAGATTCTGCCCGATCCTAGCAAGCCTTCCAAGAGGAGCTTCATCGAGGATCTGCTGTTTAATAAGGTG
ACACTGGCCGACGCTGGCTTCATTAAACAGTACGGCGATTGTCTGGGCGACATCGCTGCTAGGGATCTGA
TCTGCGCTCAGAAGTTCAACGGACTGACAGTCCTCCCTCCTCTGCTGACCGACGAGATGATCGCTCAGTA
TACCAGCGCTCTGCTGGCTGGAACCATTACCAGCGGCTGGACATTCGGCGCTGGAGCCGCCCTCCAAATT
CCCTTTGCCATGCAGATGGCCTATAGATTCAACGGCATTGGCGTCACCCAAAATGTGCTGTATGAAAATC
AGAAGCTGATTGCTAACCAATTCAATAGCGCCATTGGCAAGATCCAAGACTCTCTGAGCTCCACAGCCAG
CGCCCTCGGAAAGCTGCAAGACGTGGTGAATCAAAACGCCCAAGCTCTGAACACACTGGTGAAACAGCTC
AGCAGCAACTTTGGAGCCATCAGCAGCGTGCTCAATGATATCCTCTCTAGGCTGGACCCTCCGGAGGCCG
AAGTCCAGATCGATAGACTCATCACCGGCAGACTCCAATCTCTGCAGACATACGTCACCCAACAGCTCAT
TAGAGCTGCCGAAATCAGAGCCTCCGCCAATCTGGCCGCCACCAAGATGTCCGAGTGCGTGCTGGGACAG
AGCAAGAGAGTGGACTTCTGTGGCAAGGGATACCATCTGATGAGCTTCCCCCAGAGCGCTCCCCATGGAG
TGGTCTTTCTGCATGTCACATACGTGCCCGCCAAGAGAAGAACTTCACCACCGCTCCCGCCATTTGCCA
CGATGGAAAGGCCCACTTTCCCAGAGAAGGAGTGTTCGTGAGCAACGGCACACACTGGTTTGTCACCCAG
AGAAATTTTTACGAGCCCCAGATTATCACCACCGACAACACCTTCGTGTCCGGAAACTGCGATGTCGTGA
TTGGCATCGTGAACAACACAGTCTACGACCCTCTGCAGCCCGAACTCGACAGCTTCAAGGAAGAGCTGGA
CAAGTACTTCAAGAATCACACATCCCCCGACGTGGATCTGGGCGACATTAGCGGCATTAATGCCTCCGTC
GTCAACATTCAGAAGGAGATTGATAGACTGAATGAAGTCGCCAAGAACCTCAATGAGTCTCTGATTGATC
TGCAAGAGCTGGGCAAGTACGAGCAATACATCAAATGGCCTTGGTACATCTGGCTGGGATTCATCGCTGG
ACTCATCGCCATCGTGATGGTCACCATTATGCTGTGTTGCATGACCAGCTGCTGCAGCTGTCTGAAGGGC
TGCTGCAGCTGCGGAAGCTGCTGCAAGTTTGACGAAGACGACTCCGAGCCCGTGCTGAAGGGCGTCAAGC
TGCATTATACATAAACTAGTGCTGGAATTCGCCCTTATAGAGTGCTGGAATTCGCCCTTATAGAGTGCTG
GAATTCGCCCTTATATCTAGTAACGGCCGCCAGTGTGCTGGAATTCGCCCTTATAACTTCGTATAGCATA
CATTATACGAAGTTATAAGGGCGAATTCTGCAGATATCCATCCTTTAAAAAACCTCCCACACCTCCCCCT
GAACCTGAAACATAAAATGAATGCAATTGTTGTTGTTAACTTGTTTATTGCAGCTTATAATGGTTACAAA
```

SEQ ID NO:37 (continued)

```
TAAAGCAATAGCATCACAAATTTCACAAATAAAGCATTTTTTTCACTGCATTCTAGTTGTGGTTTGTCCA
AACTCATCAATGTATCTTAACAACGTGTTTATTTTTCAATTGCAGAAAGAATTGCAGAAAATTTCAAGTC
ATTTTTCATTCAGTAGTATAGCCCCACCACCACATAGCTTATACTAATCACCGTACCTTAATCAAACTCA
CAGAACCCTAGTATTCAACCTGCCACCTCCCTCCCAACACACAGAGTACACAGTCCTTTCTCCCCGGCTG
GCCTTAAACAGCATCATATCATGGGTAACAGACATATTCTTAGGTGTTATATTCCACACGGTCTCCTGTC
GAGCCAAACGCTCATCAGTGATGTTAATAAACTCCCCGGGCAGCTCGCTTAAGTTCATGTCGCTGTCCAG
CTGCTGAGCCACAGGCTGCTGTCCAACTTGCGGTTGCTCAACGGGCGGCGAAGGAGAAGTCCACGCCTAC
ATGGGGGTAGAGTCATAATCGTGCATCAGGATAGGGCGGTGGTGCTGCAGCAGCGCGCGAATAAACTGCT
GCCGCCGCCGCTCCGTCCTGCAGGAATACAACATGGCAGTGGTCTCCTCAGCGATGATTCGCACCGCCCG
CAGCATAAGGCGCCTTGTCCTCCGGGCACAGCAGCGCACCCTGATCTCACTTAAGTCAGCACAGTAACTG
CAGCACAGTACCACAATATTGTTTAAAATCCCACAGTGCAAGGCGCTGTATCCAAAGCTCATGGCGGGGA
CCACAGAACCCACGTGGCCATCATACCACAAGCGCAGGTAGATTAAGTGGCGACCCCTCATAAACACGCT
GGACATAAACATTACCTCTTTTGGCATGTTGTAATTCACCACCTCCCGGTACCATATAAACCTCTGATTA
AACATGGCGCCATCCACCACCATCCTAAACCAGCTGGCCAAAACCTGCCCGCCGGCTATGCACTGCAGGG
AACCGGGACTGGAACAATGACAGTGGAGAGCCCAGGACTCGTAACCATGGATCATCATGCTCGTCATGAT
ATCAATGTTGGCACAACACAGGCACACGTGCATACACTTCCTCAGGATTACAAGCTCCTCCCGCGTCAGA
ACCATATCCCAGGGAACAACCCATTCCTGAATCAGCGTAAATCCCACACTGCAGGGAAGACCTCGCACGT
AACTCACGTTGTGCATTGTCAAAGTGTTACATTCGGGCAGCAGCGGATGATCCTCCAGTATGGTAGCGCG
TGTCTCTGTCTCAAAAGGAGGTAGGCGATCCCTACTGTACGGAGTGCGCCGAGACAACCGAGATCGTGTT
GGTCGTAGTGTCATGCCAAATGGAACGCCGGACGTAGTCATATTTCCTGAAGCAAAACCAGGTGCGGGCG
TGACAAACAGATCTGCGTCTCCGGTCTCGTCGCTTAGCTCGCTCTGTGTAGTAGTTGTAGTATATCCACT
CTCTCAAAGCATCCAGGCGCCCCCTGGCTTCGGGTTCTATGTAAACTCCTTCATGCGCCGCTGCCCTGAT
AACATCCACCACCGCAGAATAAGCCACACCCAGCCAACCTACACATTCGTTCTGCGAGTCACACACGGGA
GGAGCGGGAAGAGCTGGAAGAACCATGTTTTTTTTTTTATTCCAAAAGATTATCCAAAACCTCAAAATG
AAGATCTATTAAGTGAACGCGCTCCCCTCCGGTGGCGTGGTCAAACTCTACAGCCAAAGAACAGATAATG
GCATTTGTAAGATGTTGCACAATGGCTTCCAAAAGGCAAACTGCCCTCACGTCCAAGTGGACGTAAAGGC
TAAACCCTTCANGGTGAATCTCCTCTATAAACATTCCAGCACCTTCAACCATGCCCAAATAATTTTCATC
TCGCCACCTTATCAATATGTCTCTAAGCAAATCCCGAATATTAAGTCCGGCCATTGTAAAAATCTGCTCC
AGAGCGCCCTCCACCTTCAGCCTCAAGCAGCGAATCATGATTGCAAAAATTCAGGTTCCTCACAGACCTG
TATAAGATTCAAAAGCGGAACATTAACAAAAATACCGCGATCCCGTAGGTCCCTTCGCAGGGCCAGCTGA
ACATAATCGTGCAGGTCTGCACGGACCAGCGCGGCCACTTCCCCGCCAGGAACCATGACAAAAGAACCCA
CACTGATTATGACACGCATACTCGGAGCTATGCTAACCAGCGTAGCCCCGATGTAAGCTTGTTGCATGGG
CGGCGATATAAAATGCAAGGTACTGCTCAAAAAATCAGGCAAAGCCTCGCGCAAAAAAGCAAGCACATCG
TAGTCATGCTCATGCAGATAAAGGCAGGTAAGTTCCGGAACCACCACAGAAAAGACACCATTTTTCTCT
CAAACATGTCTGCGGGTTCCTGCATAAACACAAAATAAAATAACAAAAAAAAAAAAACATTTAAACATTA
GAAGCCTGTCTTACAACAGGAAAAACAACCCTTATAAGCATAAGACGGACTACGGCCATGCCGGCGTGAC
CGTAAAAAAACTGGTCACCGTGATTAAAAAGCACCACCGACAGTTCCTCGGTCATGTCCGGAGTCATAAT
GTAAGACTCGGTAAACACATCAGGTTGGTTAACATCGGTCAGTGCTAAAAAGCGACCGAAATAGCCCGGG
GGAATACATACCCGCAGGCGTAGAGACAACATTACAGCCCCATAGGAGGTATAACAAAATTAATAGGAG
AGAAAAACACATAAACCCCTGAAAAACCCTCCTGCCCCTAGGCAAAATAGCACCCTCCCGCTCCAGAACA
ACATACAGCGCTTCCACAGCGGCAGCCATAACAGTCAGCCTTACCAGTAAAAAAACCTATTAAAAAACAC
CACTCGACACGGCACCAGCTCAATCAGTCACAGTGTAAAAAGGGCCAAGTACAGAGCGAGTATATATAGG
ACTAAAAAATGACGTAACGGTTAAAGTCCACAAAAACCACCCAGAAAACCGCACGCGAACCTACGCCCAG
AAACGAAAGCCAAAAAACCCACAACTTCCTCAAATCTTCACTTCCGTTTTCCCACGATACGTCACTTCCC
ATTTTAAAAAAAAACTACAATTCCCAATACATGCAAGTTACTCCGCCCTAAAACCTACGTCACCCGCCCC
GTTCCCACGCCCCGCGCCACGTCACAAACTCCACCCCCTCATTATCATATTGGCTTCAATCCAAAATAAG
GTATATTATTGATGATGGCGAT
```

FIG. 62 (continued)

SEQ ID NO:38

```
CGCCATCATCAATAATATACCTTATTTTGGATTGAAGCCAATATGATAATGAGGGGGTGGAGTTTGTGAC
GTGGCGCGGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTTACGTGGAGACTCGCCCAGGTGTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGTAAAGAGGGAGCGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGTGGTTATTATGA
ATGTGAGGTTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGGTGGTGTGTCGCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC
GCACCAGGTGCAGACCCTGCGAGTGTGGCGGTAAACATATTAGGAACCAGCCTGTGATGCTGGATGTGAC
```

FIG. 63

SEQ ID NO:38 (continued)

```
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGGATATGAG
ATGCATCTTGGACTGTATTTTTAGGTTGGCTATGTTCCCAGCCATATCCCTCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGGATCATGTCTACCTG
CGGGGCGATGAAGAAAACCGTTTCCGGGGTAGGGGAGATCAGCTGGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGGCCACTTCGTTAAGCATGTCCCTGACTTGCATGTTTTCCCT
GACCAAATCCGCCAGAAGGCGCTCGCCGCCCAGCGATAGCAGTTCTTGCAAGGAAGCAAAGTTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGGCGCCGCACGAGGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCTGGTCAGAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGACCCCATGGCATGGGTGGGTGAGCGCGGAGGCG
TACATGCCGCAAATGTCGTAAACGTAGAGGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
CGCGCAGCTTGTTGACCAGCTCGGCGGTGACCTGCACGTCTAGGGCGCAGTAGTCCAGGGTTTCCTTGAT
```

SEQ ID NO:38 (continued)

```
GATGTCATACTTATCCTGTCCCTTTTTTTTCCACAGCTCGCGGTTGAGGACAAACTCTTCGCGGTCTTTC
CAGTACTCTTGGATCGGAAACCCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAAGTCCGTGCGCTTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCCGCGGCGCGACTACGGTACCGCGCGG
CGGGCGGTGGGCCGCGGGGTGTCCTTGGATGATGCATCTAAAAGCGGTGACGCGGGCGGGCCCCCGGAG
GTAGGGGGGGCTCGGGACCCGCCGGGAGAGGGGGCAGGGGCACGTCGGCGCCGCGCGGGCAGGAGCTG
GTGCTGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCAAGGCCTCAAGGCGCTCCATGGCCTCGTAGAAGTCCACGG
CGAAGTTGAAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGGCCTCTTCTTCTTCTTCAATCTCCTCTTCCATA
AGGGCCTCCCCTTCTTCTTCTTCTGGCGGCGGTGGGGGAGGGGGGACACGGCGGCGACGACGGCGCACCG
GGAGGCGGTCGACAAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAAGTGCGGCGGCGG
CTGGCGGTAGAGGGGCCAGCGTAGGGTGGCCGGGCTCCGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
TAAATTCGCAAGGGTATCATGGCGGACGACCGGGGTTCGAACCCCGGATCCGGCCGTCCGCCGTGATCCA
```

SEQ ID NO:38 (continued)

```
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGTTTGACCCCGTCACTGGTCTTGTCATGCCTGGGGTATATA
CAAACGAAGCCTTCCATCCAGACATCATTTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCCGGTGGTGGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTTGGCGCGCCCGCCAGCCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GGCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
ACACCCAGTGCGCGTGCGCGGGCACTACCGCGCGCCCTGGGGCGCGCACAAACGCGGCCGCACTGGGCGC
```

SEQ ID NO:38 (continued)

```
ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAAGAAGAGATGCTCCAGGTCATCGCGCCGGAGATCTA
TGGCCCCCCGAAGAAGGAAGAGCAGGATTACAAGCCCCGAAAGCTAAAGCGGGTCAAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCGAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCCGGCGTCCGCGCCGTTCAAGGAAGTACGGCGCCGCCAGCGCGCTACTGCCCGAATATGCCCT
ACATCCTTCCATCGCGCCTACCCCGGCTATCGTGGCTACACCTACCGCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAATAAAAGTCTGGACTCTCACGCTCGCTTGGTCCTGTAACTATTTT
GTAGAATGGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CCGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTCTGGGGTGCAATCCCTGAAGCGCCGACGATGCTTCTGATCGCGGCCGCGA
TATCGCTAGCGAATTCGAAGTTCCTATTCTCTAGAAAGTATAGGAACTTCTCGAGCACGGGATCCTCTAG
AGTCGATAGCTAACGTGTCGTATGTGTGTCATGTATGCGTCCATGTCGCCGCCAGAGGAGCTGCTGAGCC
GCCGCGCGCCCGCTTTCCAAGATGGCTACCCCTTCGATGATGCCGCAGTGGTCTTACATGCACATCTCGG
GCCAGGACGCCTCGGAGTACCTGAGCCCCGGGCTGGTGCAGTTTGCCCGCGCCACCGAGACGTACTTCAG
CCTGAATAACAAGTTTAGAAACCCCACGGTGGCGCCTACGCACGACGTGACCACAGACCGGTCCCAGCGT
TTGACGCTGCGGTTCATCCCTGTGGACCGTGAGGATACTGCGTACTCGTACAAGGCGCGGTTCACCCTAG
CTGTGGGTGATAACCGTGTGCTGGACATGGCTTCCACGTACTTTGACATCCGCGGCGTGCTGGACAGGGG
CCCTACTTTTAAGCCCTACTCTGGCACTGCCTACAACGCCCTGGCTCCCAAGGGTGCCCCAAATCCTTGC
GAATGGACATATAAAGCCGATGGTGAAACTGCCACAGAAAAACCCACGTATTTGGGCAGGCGCCTTATT
CTGGTATAAATATTACAAAAGATGGTATTCAACTTGGAACTGACACCGATGATCAGCCAATCTACGCAGA
TAAAACATTTCAACCTGAACCTCAAATAGGAGAATCTCAGTGGTACGAAACTGAAATTAATCATGCAGCT
GGGAGAGTCCTTAAAAAGACTACCCCAATGAAACCATGTTACGGTTCATATGCAAAACCCACAAATGAAA
ATGGAGGGCAAGCAAATGTGAAAACAGGAACAGGCACTACTAAAGAATATGACATAGACATGCAATTTTT
```

FIG. 63 (continued)

SEQ ID NO:38 (continued)

```
CGACAACAGAAGTGCGGCTGCTGCTGGCCTAGCTCCAGAAGTGGTATTGTACAGTGAAGATGTAGATATA
GAAACCCCAGACACTCATATTTCTTACATGCCCACTATTAAGGAAGGTAACTCACGAGAACTAATGGGCC
AACAATCTATGCCCAACAGGCCTAATTACATTGCTTTTAGGGACAATTTTATTGGTCTAATGTATTACAA
CAGCACGGGTAATATGGGTGTTCTGGCGGGCCAAGCATCGCAGTTGAATGCTGTTGTAGATTTGCAAGAC
AGAAACACAGAGCTTTCATACCAGCTTTTGCTTGATTCCATTGGTGATAGAACCAGGTACTTTTCTATGT
GGAATCAGGCTGTTGACAGCTATGATCCAGATGTTAGAATTATTGAAAATCATGGAACTGAAGATGAACT
TCCAAATTACTGCTTTCCACTGGGAGGTGTGATTAGAACAGATACTTATCAGGGAATTAAGGCTAATGGA
ACTGATCAAACCACATGGACCAAAGATGACAGTGTCAATGATGCTAATGAGGAAATAAGAGTTGGAAATA
ATTTTGCCATGGAAATCAATCTAAATGCCAACCTGTGGAGAAATTTCCTGTACTCCAACATAGCGCTGTA
TTTGCCCGACAAGCTAAAGTACAGTCCTTCCAACGTAAAAATTTCTGATAACCCAAACACCTACGACTAC
ATGAACAAGCGAGTGGTGGCTCCCGGGTTAGTGGACTGCTACATTAACCTTGGAGCACGCTGGTCCCTTG
ACTATATGGACAACGTCAACCCATTTAACCACCACCGCAATGCTGGCCTGCGCTACCGCTCAATGTTGCT
GGGCAATGGTCGCTATGTGCCCTTCCACATCCAGGTGCCTCAGAAGTTCTTTGCCATTAAAAACCTCCTT
CTCCTGCCGGGCTCATACACCTACGAGTGGAACTTCAGGAAGGATGTTAACATGGTTCTGCAGAGCTCTC
TGGGAAACGACCTTAGAGTTGACGGGGCTAGCATTAAGTTTGACAGCATTTGTCTTTACGCCACCTTCTT
CCCCATGGCCCACAACACGGCCTCCACGCTGGAAGCCATGCTCAGAAATGACACCAACGACCAGTCCTTT
AATGACTACCTTTCCGCCGCCAACATGCTATATCCCATACCCGCCAACGCCACCAACGTGCCCATCTCCA
TCCCATCGCGCAACTGGGCAGCATTTCGCGGTTGGGCCTTCACACGCTTGAAGACAAAGGAAACCCCTTC
CCTGGGATCAGGCTACGACCCTTACTACACCTACTCTGGCTCCATACCATACCTTGACGGAACCTTCTAT
CTTAATCACACCTTTAAGAAGGTGGCCATTACTTTTGACTCTTCTGTTAGCTGGCCGGGCAACGACCGCC
TGCTTACTCCCAATGAGTTTGAGATTAAGCGCTCAGTTGACGGGGAGGGCTATAACGTAGCTCAGTGCAA
CATGACAAAGGACTGGTTCCTAGTGCAGATGTTGGCCAACTACAATATTGGCTACCAGGGCTTCTACATT
CCAGAAAGCTACAAAGACCGCATGTACTCGTTCTTCAGAAACTTCCAGCCCATGAGCCGGCAAGTGGTGG
ACGATACTAAATACAAAGATTATCAGCAGGTTGGAATTATCCACCAGCATAACAACTCAGGCTTCGTAGG
CTACCTCGCTCCCACCATGCGCGAGGGACAAGCTTACCCCGCTAATGTTCCCTACCCACTAATAGGCAAA
ACCGCGGTTGATAGTATTACCCAGAAAAAGTTTCTTTGCGACCGCACCCTGTGGCGCATCCCCTTCTCCA
GTAACTTTATGTCCATGGGTGCGCTCACAGACCTGGGCCAAAACCTTCTCTACGCAAACTCCGCCCACGC
GCTAGACATGACCTTTGAGGTGGATCCCATGGACGAGCCCACCCTTCTTTATGTTTTGTTTGAAGTCTTT
GACGTGGTCCGTGTGCACCAGCCGCACCGCGGCGTCATCGAGACCGTGTACCTGCGCACGCCCTTCTCGG
CCGGCAACGCCACAACATAAAGAAGCAAGCAACATCAACAACAGCTGCCGCCATGGGCTCCAGTGAGCAG
GAACTGAAAGCCATTGTCAAAGATCTTGGTTGTGGGCCATATTTTTGGGCACCTATGACAAGCGCTTCC
CAGGCTTTGTTTCCCCACACAAGCTCGCCTGCGCCATAGTTAACACGGCCGGTCGCGAGACTGGGGCGT
ACACTGGATGGCCTTTGCCTGGAACCCGCGCTCAAAAACATGCTACCTCTTTGAGCCCTTTGGCTTTTCT
GACCAACGTCTCAAGCAGGTTTACCAGTTTGAGTACGAGTCACTCCTGCGCCGTAGCGCCATTGCCTCTT
CCCCCGACCGCTGTATAACGCTGGAAAAGTCCACCCAAAGCGTGCAGGGGCCCAACTCGGCCGCCTGTGG
CCTATTCTGCTGCATGTTTCTCCACGCCTTTGCCAACTGGCCCCAAACTCCCATGGATCACAACCCCACC
ATGAACCTTATTACCGGGGTACCCAACTCCATGCTTAACAGTCCCCAGGTACAGCCCACCCTGCGCCGCA
ACCAGGAACAGCTCTACAGCTTCCTGGAGCGCCACTCGCCCTACTTCCGCAGCCACAGTGCGCAAATTAG
GAGCGCCACTTCTTTTGTCACTTGAAAAACATGTAAAAATAATGTACTAGGAGACACTTTCAATAAAGG
CAAATGTTTTTATTTGTACACTCTCGGGTGATTATTTACCCCCACCCTTGCCGTCTGCGCCGTTTAAAAA
TCAAAGGGGTTCTGCCGCGCATCGCTATGCGCCACTGGCAGGGACACGTTGCGATACTGGTGTTTAGTGC
TCCACTTAAACTCAGGCACAACCATCCGCGGCAGCTCGGTGAAGTTTTCACTCCACAGGCTGCGCACCAT
CACCAACGCGTTTAGCAGGTCGGGCGCCGATATCTTGAAGTCGCAGTTGGGGCCTCCGCCCTGCGCGCGC
GAGTTGCGATACACAGGGTTACAGCACTGGAACACTATCAGCGCCGGGTGGTGCACGCTGGCCAGCACGC
TCTTGTCGGAGATCANATCCGCGTCCAGGTCCTCCGCGTTGCTCAGGGCGAACGGAGTCAACTTTGGTAG
CTGCCTTCCCAAAAAGGGTGCATGCCCAGGCTTTGAGTTGCACTCGCACCGTAGTGGCATCAGAAGGTGA
CCGTGCCCAGTCTGGGCGTTAGGATACAGCGCCTGCATGAAAGCCTTGATCTGCTTAAAAGCCACCTGAG
CCTTTGCGCCTTCAGAGAAGAACATGCCGCAAGACTTGCCGGAAAACTGATTGGCCGGACAGGCCGCGTC
ATGCACGCAGCACCTTGCGTCGGTGTTGGAGATCTGCACCACATTTCGGCCCCACCGGTTCTTCACGATC
TTGGCCTTGCTAGACTGCTCCTTCAGCGCGCGCTGCCCGTTTTCGCTCGTCACATCCATTTCAATCACGT
GCTCCTTATTTATCATAATGCTCCCGTGTAGACACTTAAGCTCGCCTTCGATCTCAGCGCAGCGGTGCAG
CCACAACGCGCAGCCCGTGGGCTCGTGGTGCTTGTAGGTTACCTCTGCAAACGACTGCAGGTACGCCTGC
```

SEQ ID NO:38 (continued)

```
AGGAATCGCCCCATCATCGTCACAAAGGTCTTGTTGCTGGTGAAGGTCAGCTGCAACCCGCGGTGCTCCT
CGTTTAGCCAGGTCTTGCATACGGCCGCCAGAGCTTCCACTTGGTCAGGCAGTAGCTTGAAGTTTGCCTT
TAGATCGTTATCCACGTGGTACTTGTCCATCAACGCGCGCGCAGCCTCCATGCCCTTCTCCCACGCAGAC
ACGATCGGCAGGCTCAGCGGGTTTATCACCGTGCTTTCACTTTCCGCTTCACTGGACTCTTCCTTTTCCT
CTTGCATCCGCATACCCCGCGCCACTGGGTCGTCTTCATTCAGCCGCCGCACCGTGCGCTTACCTCCCTT
GCCGTGCTTGATTAGCACCGGTGGGTTGCTGAAACCCACCATTTGTAGCGCCACATCTTCTCTTTCTTCC
TCGCTGTCCACGATCACCTCTGGGGATGGCGGGCGCTCGGGCTTGGGAGAGGGGCGCTTCTTTTTCTTTT
TGGACGCAATGGCCAAATCCGCCGTCGAGGTCGATGGCCGCGGGCTGGGTGTGCGCGGCACCAGCGCATC
TTGTGACGAGTCTTCTTCGTCCTCGGACTCGAGACGCCGCCTCAGCCGCTTTTTGGGGCGCGCGGGGA
GGCGGCGGCGACGGCGACGGGGACGAGACGTCCTCCATGGTTGGTGGACGTCGCGCCGCACCGCGTCCGC
GCTCGGGGGTGGTTTCGCGCTGCTCCTCTTCCCGACTGGCCATTTCCTTCTCCTATAGGCAGAAAAAGAT
CATGGAGTCAGTCGAGAAGGAGGACAGCCTAACCGCCCCCTTTGAGTTCGCCACCACCGCCTCCACCGAT
GCCGCCAACGCGCCTACCACCTTCCCCGTCGAGGCACCCCCGCTTGAGGAGGAGGAAGTGATTATCGAGC
AGGACCCAGGTTTTGTAAGCGAAGACGACGAAGATCGCTCAGTACCAACAGAGGATAAAAAGCAAGACCA
GGACGACGCAGAGGCAAACGAGGAACAAGTCGGGCGGGGGGACCAAAGGCATGGCGACTACCTAGATGTG
GGAGACGACGTGCTGTTGAAGCATCTGCAGCGCCAGTGCGCCATTATCTGCGACGCGTTGCAAGAGCGCA
GCGATGTGCCCCTCGCCATAGCGGATGTCAGCCTTGCCTACGAACGCCACCTGTTCTCACCGCGCGTACC
CCCCAAACGCCAAGAAAACGGCACATGCGAGCCCAACCCGCGCCTCAACTTCTACCCCGTATTTGCCGTG
CCAGAGGTGCTTGCCACCTATCACATCTTTTTCCAAAACTGCAAGATACCCCTATCCTGCCGTGCCAACC
GCAGCCGAGCGGACAAGCAGCTGGCCTTGCGGCAGGGCGCTGTCATACCTGATATCGCCTCGCTCGACGA
AGTGCCAAAAATCTTTGAGGGTCTTGGACGCGACGAGAAGCGCGCGGCAAACGCTCTGCAACAAGAAAAC
AGCGAAAATGAAAGTCACTGTGGAGTGCTGGTGGAACTTGAGGGTGACAACGCGCGCCTAGCCGTGCTGA
AACGCAGCATCGAGGTCACCCACTTTGCCTACCCGGCACTTAACCTACCCCCCAAGGTTATGAGCACAGT
CATGAGCGAGCTGATCGTGCGCCGTGCACGACCCTGGAGAGGGATGCAAACTTGCAAGAACAAACCGAG
GAGGGCCTACCCGCAGTTGGCGATGAGCAGCTGGCGCGCTGGCTTGAGACGCGCGAGCCTGCCGACTTGG
AGGAGCGACGCAAGCTAATGATGGCCGCAGTGCTTGTTACCGTGGAGCTTGAGTGCATGCAGCGGTTCTT
TGCTGACCCGGAGATGCAGCGCAAGCTAGAGGAAACGTTGCACTACACCTTTCGCCAGGGCTACGTGCGC
CAGGCCTGCAAAATTTCCAACGTGGAGCTCTGCAACCTGGTCTCCTACCTTGGAATTTTGCACGAAAACC
GCCTTGGGCAAAACGTGCTTCATTCCACGCTCAAGGGCGAGGCGCGCCGCGACTACGTCCGCGACTGCGT
TTACTTATTTCTGTGCTACACCTGGCAAACGGCCATGGGCGTGTGGCAGCAGTGCCTGGAGGAGCGCAAC
CTGAAGGAGCTGCAGAAGCTGCTAAAGCAAAACTTGAAGGACCTATGGACGGCCTTCAACGAGCGCTCCG
TGGCCGCGCACCTGGCGGACATTATCTTCCCCGAACGCCTGCTTAAAACCCTGCAACAGGGTCTGCCAGA
CTTCACCAGTCAAAGCATGTTGCAAAACTTTAGGAACTTTATCCTAGAGCGTTCAGGAATTCTGCCCGCC
ACCTGCTGTGCGCTTCCTAGCGACTTTGTGCCCATTAAGTACCGTGAATGCCCTCCGCCGCTTTGGGGTC
ACTGCTACCTTNTGCAGCTAGCCAACTACCTTGCCTACCACTCCGACATCATGGAAGACGTGAGCGGTGA
CGGCCTACTGGAGTGTCACTGTCGCTGCAACCTATGCACCCCGCACCGCTCCTGGTCTGCAATTCACAA
CTGCTTAGCGAAAGTCAAATTATCGGTACCTTTGAGCTGCAGGGTCCCTCGCCTGACGAAAAGTCCGCGG
CTCCGGGGTTGAAACTCACTCCGGGGCTGTGGACGTCGGCTTACCTTCGCAAATTTGTACCTGAGGACTA
CCACGCCCACGAGATTAGGTTCTACGAAGACCAATCCCGCCCGCCAAATGCGGAGCTTACCGCCTGCGTC
ATTACCCAGGGCCACATCCTTGGCCAATTGCAAGCCATTAACAAAGCCCGCCAAGAGTTTCTGCTACGAA
AGGGACGGGGGGTTTACTTGGACCCCCAGTCCGGCGAGGAGCTCAACCCAATCCCCCCGCCGCCGCAGCC
CTATCAGCAGCCGCGGGCCCTTGCTTCCAGGATGGCACCCAAAAAGAAGCTGCAGCTGCCGCCGCCGCC
ACCCACGGACGAGGAGGAATACTGGGACAGTCAGGCAGAGGAGGTTTTGGACGAGGAGGAGGAGATGATG
GAAGACTGGGACAGCCTAGACGAGGAAGCTTCCGAGGCCGAAGAGGTGTCAGACGAAACACCGTCACCCT
CGGTCGCATTCCCCTCGCCGGCGCCCCAGAAATCGGCAACCGTTCCCAGCATTGCTACAACCTCCGCTCC
TCAGGCGCCGCCGGCACTGCCCGTTCGCCGACCCAACCGTAGATGGGACACCACTGGAACCAGGGCCGGT
AAGTCTAAGCAGCCGCCGCCGTTAGCCCAAGAGCAACAACAGCGCCAAGGCTACCGCTCGTGGCGCGTGC
ACAAGAACGCCATAGTTGCTTGCTTGCAAGACTGTGGGGCAACATCTCCTTCGCCCGCCGCTTTCTTCT
CTACCATCACGGCGTGGCCTTCCCCCGTAACATCCTGCATTACTACCGTCATCTCTACAGCCCCTACTGC
ACCGGCGGCAGCGGCAGCAACAGCAGCGGCCACGCAGAAGCAAAGGCGACCGGATAGCAAGACTCTGACA
AAGCCCAAGAAATCCACAGCGGCGGCAGCAGCAGGAGGAGGAGCACTGCGTCTGGCGCCCAACGAACCCG
TATCGACCCGCGAGCTTAGAAACAGGATTTTTCCCACTCTGTATGCTATATTTCAACAGAGCAGGGGCCA
```

SEQ ID NO:38 (continued)

```
AGAACAAGAGCTGAAAATAAAAAACAGGTCTCTGCGCTCCCTCACCCGCAGCTGCCTGTATCACAAAAGC
GAAGATCAGCTTCGGCGCACGCTGGAAGACGCGGAGGCTCTCTTCAGCAAATACTGCGCGCTGACTCTTA
AGGACTAGTTTCGCGCCCTTTCTCAAATTTAAGCGCGAAAACTACGTCATCTCCAGCGGCCACACCCGGC
GCCAGCACCTGTCGTCAGCGCCATTATGAGCAAGGAAATTCCCACGCCCTACATGTGGAGTTACCAGCCA
CAAATGGACTTGCGGCTGGAGCTGCCCAAGACTACTCAACCCGAATAAACTACATGAGCGCGGGACCCC
ACATGATATCCCGGGTCAACGGAATCCGCGCCCACCGAAACCGAATTCTCCTCGAACAGGCGGCTATTAC
CACCACACCTCGTAATAACCTTAATCCCCGTAGTTGGCCCGCTGCCCTGGTGTACCAGGAAAGTCCCGCT
CCCACCACTGTGGTACTTCCCAGAGACGCCCAGGCCGAAGTTCAGATGACTAACTCAGGGGCGCAGCTTG
CGGGCGGCTTTCGTCACAGGGTGCGGTCGCCCGGGCAGGGTATAACTCACCTGAAAATCAGAGGGCGAGG
TATTCAGCTCAACGACGAGTCGGTGAGCTCCTCTCTTGGTCTCCGTCCGGACGGGACATTTCAGATCGGC
GGCGCTGGCCGCTCTTCATTTACGCCCGTCAGGCGATCCTAACTCTGCAGACCTCGTCCTCGGAGCCGC
GCTCCGGAGGCATTGGAACTCTACAATTTATTGAGGAGTTCGTGCCTTCGGTTTACTTCAACCCCTTTTC
TGGACCTCCCGGCCACTACCCGGACCAGTTTATTCCCAACTTTGACGCGGTAAAAGACTCGGCGGACGGC
TACGACTGACAGATCTGAGCTCGCGGCCGCGATATCGCTAGCGAAGTTCCTATTCTCTAGAAAGTATAGG
AACTTCGATCCTCTAGAGTCGACCTGCAGGCATGCAAGCTTGGCACTGCAATAAATTACTTACTTAAAAT
CAGTCAGCAAATCTTTGTCCAGCTTATTCAGCATCACCTCCTTTCCCTCCTCCCAACTCTGGTATTTCAG
CAGCCTTTTAGCTGCGAACTTTCTCCAAAGTCTAAATGGGATGTCAAATTCCTCATGTTCTTGTCCCTCC
GCACCCACTATCTTCATATTGTTGCAGATGAAACGCGCCAGACCGTCTGAAGACACCTTCAACCCTGTGT
ACCCATATGACACGGAAACCGGCCCTCCAACTGTGCCTTTCCTTACCCCTCCCTTTGTGTCGCCAAATGG
GTTCCAAGAAAGTCCCCCCGGAGTGCTTTCTTTGCGTCTTTCAGAACCTTTGGTTACCTCACACGGCATG
CTTGCGCTAAAAATGGGCAGCGGCCTGTCCCTGGATCAGGCAGGCAACCTTACATCAAATACAATCACTG
TTTCTCAACCGCTAAAAAAACAAAGTCCAATATAACTTTGGAAACATCCGCGCCCTTACAGTCAGCTC
AGGCGCCCTAACCATGGCCACAACTTCGCCTTTGGTGGTCTCTGACAACACTCTTACCATGCAATCACAA
GCACCGCTAACCGTGCAAGACTCAAAACTTAGCATTGCTACCAAAGAGCCACTTACAGTGTTAGATGGAA
AACTGGCCCTGCAGACATCAGCCCCCTCTCTGCCACTGATAACAACGCCCTCACTATCACTGCCTCACC
TCCTCTTACTACTGCAAATGGTAGTCTGGCTGTTACCATGGAAAACCCACTTTACAACAACAATGGAAAA
CTTGGGCTCAAAATTGGCGGTCCTTTGCAAGTGGCCACCGACTCACATGCACTAACACTAGGTACTGGTC
AGGGGGTTGCAGTTCATAACAATTTGCTACATACAAAAGTTACAGGCGCAATAGGGTTTGATACATCTGG
CAACATGGAACTTAAAACTGGAGATGGCCTCTATGTGGATAGCGCCGGTCCTAACCAAAAACTACATATT
AATCTAAATACCACAAAAGGCCTTGCTTTTGACAACACCGCAATAACAATTAACGCTGGAAAAGGGTTGG
AATTTGAAACAGACTCCTCAAACGGAAATCCCATAAAAACAAAAATTGGATCAGGCATACAATATAATAC
CAATGGAGCTATGGTTGCAAAACTTGGAACAGGCCTCAGTTTTGACAGCTCCGGAGCCATAACAATGGGC
AGCATAAACAATGACAGACTTACTCTTTGGACAACACCAGACCCATCCCCAAATTGCAGAATTGCTTCAG
ATAAAGACTGCAAGCTAACTCTGGCGCTAACAAAATGTGGCAGTCAAATTTTGGGCACTGTTTCAGCTTT
GGCAGTATCAGGTAATATGGCCTCCATCAATGGAACTCTAAGCAGTGTAAACTTGGTTCTTAGATTTGAT
GACAACGGAGTGCTTATGTCAAATTCATCACTGGACAAACAGTATTGGAACTTTAGAAACGGGGACTCCA
CTAACGGTCAACCATACACTTATGCTGTTGGGTTTATGCCAAACCTAAAAGCTTACCCAAAAACTCAAAG
TAAAACTGCAAAAGTAATATTGTTAGCCAGGTGTATCTTAATGGTGACAAGTCTAAACCATTGCATTTT
ACTATTACGCTAAATGGAACAGATGAAACCAACCAAGTAAGCAAATACTCAATATCATTCAGTTGGTCCT
GGAACAGTGGACAATACACTAATGACAAATTTGCCACCAATTCCTATACCTTCTCCTACATTGCCCAGGA
ATAAAGAATCGTGAACCTGTTGCATGTTATGTTTCAACGTGTTTATTTTTCAATTCGTATTAGTCATCGC
TATTACCATGGTGATGCGGTTTTGGCAGTACATCAATGGGCGTGGATAGCGGTTTGACTCACGGGGATTT
CCAAGTCTCCACCCCATTGACGTCAATGGGAGTTTGTTTTGGCACCAAAATCAACGGGACTTTCCAAAAT
GTCGTAACAACTCCGCCCCATTGACGCAAATGGGCGGTAGGCGTGTACGGTGGGAGGTCTATATAAGCAG
AGCTGGTTTAGTGAACCGTCAGATCCGCTAGAGATCCACCATGTTTGTCTTTCTCGTGCTGCTGCCCCTC
GTGAGCAGCCAGTGCGTCAATCTGACAACAAGGACCCAGCTGCCCCCGCCTACACCAACTCCTTCACAA
GAGGCGTGTATTACCCCGATAAGGTCTTCAGATCCAGCGTCCTCCACAGCACCCAAGATTTGTTTCTGCC
TTTCTTCAGCAACGTGACATGGTTCCACGCCATTCATGTCAGCGGCACAAACGGCACAAGAGGTTTGAC
AACCCCGTGCTCCCCTTCAACGACGGCGTGTACTTCGCCAGCACAGAGAAATCCAATATCATTAGGGCT
GGATCTTCGGCACAACACTGGATTCCAAGACCCAGTCTCTGCTCATTGTGAATAACGCCACCAACGTGGT
GATTAAGGTCTGTGAGTTTCAGTTCTGCAACGACCCCTTTCTGGGAGTCTACTACCACAAGAATAATAAG
AGCTGGATGGAGTCCGAGTTTAGGGTGTACAGCTCCGCCAACAACTGTACCTTCGAATACGTGTCCCAGC
```

SEQ ID NO:38 (continued)

```
CTTTCCTCATGGATCTGGAGGGCAAGCAAGGCAATTTCAAAAATCTGAGAGAGTTCGTGTTCAAAAACAT
TGATGGATACTTCAAAATCTACAGCAAGCATACCCCCATTAATCTGGTGAGGGATCTGCCCCAAGGATTC
TCCGCTCTGGAACCTCTGGTGGATCTGCCCATTGGCATTAACATCACAAGATTCCAGACCCTCCTCGCCC
TCCATAGATCCTATCTGACCCCCGGCGACTCCTCCAGCGGATGGACAGCCGGAGCTGCCGCCTACTACGT
GGGCTATCTGCAGCCAAGAACCTTTCTGCTGAAGTACAACGAGAACGGCACCATCACAGACGCTGTCGAT
TGCGCTCTCGACCCTCTGAGCGAGACCAAATGCACACTGAAGAGCTTCACCGTGGAAAAGGGCATCTATC
AGACCAGCAACTTCAGAGTGCAGCCTACCGAGAGCATTGTGAGGTTTCCCAACATCACCAATCTGTGTCC
TTTCGGCGAGGTCTTTAATGCCACAAGGTTCGCTTCCGTGTATGCTTGGAATAGGAAGAGGATCAGCAAT
TGCGTCGCCGACTATTCCGTCCTCTATAACAGCGCCTCCTTCTCCACCTTCAAATGTTATGGCGTGTCCC
CCACCAAGCTCAACGACCTCTGCTTCACCAATGTGTACGCTGACTCCTTCGTCATTAGGGGCGACGAGGT
GAGGCAAATTGCCCCCGGCCAGACCGGCAAGATTGCTGATTACAACTACAAACTGCCCGACGATTTTACC
GGCTGCGTGATCGCTTGGAACTCCAACAATCTGGACTCCAAAGTGGGCGGAAACTACAATTACCTCTACA
GACTCTTTAGAAAAAGCAATCTGAAGCCCTTCGAGAGAGACATCTCCACCGAAATCTACCAAGCCGGAAG
CACACCTTGCAATGGCGTCGAGGGATTTAACTGCTACTTCCCTCTGCAGAGCTACGGCTTTCAACCTACC
AACGGCGTCGGATATCAACCCTATAGGGTGGTCGTGCTGAGCTTTGAACTGCTGCATGCTCCCGCCACCG
TCTGCGGACCTAAGAAGAGCACCAATCTCGTCAAAAACAAGTGCGTGAACTTCAACTTCAATGGACTGAC
CGGCACCGGCGTGCTGACCGAGAGCAATAAGAAGTTTCTGCCCTTCCAGCAGTTCGGAAGGGATATTGCC
GATACCACAGATGCTGTGAGGGACCCCCAAACCCTCGAGATTCTGGATATCACCCCTTGCAGCTTCGGAG
GAGTGTCCGTGATCACCCCCGGAACAAACACCTCCAATCAAGTGGCTGTGCTGTACCAAGACGTGAACTG
CACAGAAGTCCCCGTGGCCATCCATGCCGACCAGCTGACCCCTACATGGAGAGTGTACTCCACCGGCAGC
AATGTGTTCCAGACAAGAGCCGGATGCCTCATTGGAGCTGAACACGTCAACAACAGCTACGAGTGCGACA
TTCCCATCGGCGCCGGCATTTGTGCCTCCTATCAGACCCAGACCAACAGCCCAAGAAGGGCTAGAAGCGT
CGCTTCCCAATCCATCATTGCCTACACCATGTCTCTGGGAGCCGAAAACTCCGTCGCCTACTCCAACAAT
AGCATCGCCATCCCCACCAATTTTACCATCTCCGTGACCACAGAGATTCTGCCCGTGTCCATGACAAAGA
CATCCGTGGACTGCACCATGTACATCTGTGGCGACAGCACCGAGTGTAGCAATCTGCTGCTGCAATATGG
CAGCTTCTGCACCCAGCTGAACAGAGCCCTCACCGGCATCGCCGTCGAACAAGACAAGAACACCCAAGAG
GTGTTCGCCCAAGTGAAGCAAATCTACAAGACCCCCCCTATCAAAGATTTCGGAGGATTCAACTTTAGCC
AGATTCTGCCCGATCCTAGCAAGCCTTCCAAGAGGAGCTTCATCGAGGATCTGCTGTTTAATAAGGTGAC
ACTGGCCGACGCTGGCTTCATTAAACAGTACGGCGATTGTCTGGGCGACATCGCTGCTAGGGATCTGATC
TGCGCTCAGAAGTTCAACGGACTGACAGTCCTCCCTCCTCTGCTGACCGACGAGATGATCGCTCAGTATA
CCAGCGCTCTGCTGGCTGGAACCATTACCAGCGGCTGGACATTCGGCGCTGGAGCCGCCCTCCAAATTCC
CTTTGCCATGCAGATGGCCTATAGATTCAACGGCATTGGCGTCACCCAAAATGTGCTGTATGAAAATCAG
AAGCTGATTGCTAACCAATTCAATAGCGCCATTGGCAAGATCCAAGACTCTCTGAGCTCCACAGCCAGCG
CCCTCGGAAAGCTGCAAGACGTGGTGAATCAAAACGCCCAAGCTCTGAACACACTGGTGAAACAGCTCAG
CAGCAACTTTGGAGCCATCAGCAGCGTGCTCAATGATATCCTCTCTAGGCTGGACAAAGTGGAGGCCGAA
GTCCAGATCGATAGACTCATCACCGGCAGACTCCAATCTCTGCAGACATACGTCACCCAACAGCTCATTA
GAGCTGCCGAAATCAGAGCCTCCGCCAATCTGGCCGCCACCAAGATGTCCGAGTGCGTGCTGGGACAGAG
CAAGAGAGTGGACTTCTGTGGCAAGGGATACCATCTGATGAGCTTCCCCCAGAGCGCTCCCCATGGAGTG
GTCTTTCTGCATGTCACATACGTGCCCGCCCAAGAGAAGAACTTCACCACCGCTCCCGCCATTTGCCACG
ATGGAAAGGCCCACTTTCCCAGAGAAGGAGTGTTCGTGAGCAACGGCACACACTGGTTTGTCACCCAGAG
AAATTTTTACGAGCCCCAGATTATCACCACCGACAACACCTTCGTGTCCGGAAACTGCGATGTCGTGATT
GGCATCGTGAACAACACAGTCTACGACCCTCTGCAGCCCGAACTCGACAGCTTCAAGGAAGAGCTGGACA
AGTACTTCAAGAATCACACATCCCCCGACGTGGATCTGGGCGACATTAGCGGCATTAATGCCTCCGTCGT
CAACATTCAGAAGGAGATTGATAGACTGAATGAAGTCGCCAAGAACCTCAATGAGTCTCTGATTGATCTG
CAAGAGCTGGGCAAGTACGAGCAATACATCAAATGGCCTTGGTACATCTGGCTGGGATTCATCGCTGGAC
TCATCGCCATCGTGATGGTCACCATTATGCTGTGTTGCATGACCAGCTGCTGCAGCTGTCTGAAGGGCTG
CTGCAGCTGCGGAAGCTGCTGCAAGTTTGACGAAGACGACTCCGAGCCCGTGCTGAAGGGCGTCAAGCTG
CATTATACATAAACTAGTGCTGGAATTCGCCCTTATAGAGTGCTGGAATTCGCCCTTATAGAGTGCTGGA
ATTCGCCCTTATATCTAGTAACGGCCGCCAGTGTGCTGGAATTCGCCCTTATAACTTCGTATAGCATACA
TTATACGAAGTTATAAGGGCGAATTCTGCAGATATCCATCCTTTAAAAACCTCCCACACCTCCCCCTGA
ACCTGAAACATAAAATGAATGCAATTGTTGTTGTTAACTTGTTTATTGCAGCTTATAATGGTTACAAATA
AAGCAATAGCATCACAAATTTCACAAATAAAGCATTTTTTCACTGCATTCTAGTTGTGGTTTGTCCAAA
```

FIG. 63 (continued)

SEQ ID NO:38 (continued)

```
CTCATCAATGTATCTTAACAACGTGTTTATTTTTCAATTGCAGAAAGAATTGCAGAAAATTTCAAGTCAT
TTTTCATTCAGTAGTATAGCCCCACCACCACATAGCTTATACTAATCACCGTACCTTAATCAAACTCACA
GAACCCTAGTATTCAACCTGCCACCTCCCTCCCAACACACAGAGTACACAGTCCTTTCTCCCCGGCTGGC
CTTAAACAGCATCATATCATGGGTAACAGACATATTCTTAGGTGTTATATTCCACACGGTCTCCTGTCGA
GCCAAACGCTCATCAGTGATGTTAATAAACTCCCCGGGCAGCTCGCTTAAGTTCATGTCGCTGTCCAGCT
GCTGAGCCACAGGCTGCTGTCCAACTTGCGGTTGCTCAACGGGCGGCGAAGGAGAAGTCCACGCCTACAT
GGGGGTAGAGTCATAATCGTGCATCAGGATAGGGCGGTGGTGCTGCAGCAGCGCGCGAATAAACTGCTGC
CGCCGCCGCTCCGTCCTGCAGGAATACAACATGGCAGTGGTCTCCTCAGCGATGATTCGCACCGCCCGCA
GCATAAGGCGCCTTGTCCTCCGGGCACAGCAGCGCACCCTGATCTCACTTAAGTCAGCACAGTAACTGCA
GCACAGTACCACAATATTGTTTAAAATCCCACAGTGCAAGGCGCTGTATCCAAAGCTCATGGCGGGGACC
ACAGAACCCACGTGGCCATCATACCACAAGCGCAGGTAGATTAAGTGGCGACCCCTCATAAACACGCTGG
ACATAAACATTACCTCTTTTGGCATGTTGTAATTCACCACCTCCCGGTACCATATAAACCTCTGATTAAA
CATGGCGCCATCCACCACCATCCTAAACCAGCTGGCCAAAACCTGCCCGCCGGCTATGCACTGCAGGGAA
CCGGGACTGGAACAATGACAGTGGAGAGCCCAGGACTCGTAACCATGGATCATCATGCTCGTCATGATAT
CAATGTTGGCACAACACAGGCACACGTGCATACACTTCCTCAGGATTACAAGCTCCTCCCGCGTCAGAAC
CATATCCCAGGGAACAACCCATTCCTGAATCAGCGTAAATCCCACACTGCAGGGAAGACCTCGCACGTAA
CTCACGTTGTGCATTGTCAAAGTGTTACATTCGGGCAGCAGCGGATGATCCTCCAGTATGGTAGCGCGTG
TCTCTGTCTCAAAAGGAGGTAGGCGATCCCTACTGTACGGAGTGCGCCGAGACAACCGAGATCGTGTTGG
TCGTAGTGTCATGCCAAATGGAACGCCGGACGTAGTCATATTTCCTGAAGCAAAACCAGGTGCGGGCGTG
ACAAACAGATCTGCGTCTCCGGTCTCGTCGCTTAGCTCGCTCTGTGTAGTAGTTGTAGTATATCCACTCT
CTCAAAGCATCCAGGCGCCCCTGGCTTCGGGTTCTATGTAAACTCCTTCATGCGCCGCTGCCCTGATAA
CATCCACCACCGCAGAATAAGCCACACCCAGCCAACCTACACATTCGTTCTGCGAGTCACACACGGGAGG
AGCGGGAAGAGCTGGAAGAACCATGTTTTTTTTTTTATTCCAAAAGATTATCCAAAACCTCAAAATGAA
GATCTATTAAGTGAACGCGCTCCCCTCCGGTGGCGTGGTCAAACTCTACAGCCAAAGAACAGATAATGGC
ATTTGTAAGATGTTGCACAATGGCTTCCAAAAGGCAAACTGCCCTCACGTCCAAGTGGACGTAAAGGCTA
AACCCTTCANGGTGAATCTCCTCTATAAACATTCCAGCACCTTCAACCATGCCCAAATAATTTTCATCTC
GCCACCTTATCAATATGTCTCTAAGCAAATCCCGAATATTAAGTCCGGCCATTGTAAAAATCTGCTCCAG
AGCGCCCTCCACCTTCAGCCTCAAGCAGCGAATCATGATTGCAAAAATTCAGGTTCCTCACAGACCTGTA
TAAGATTCAAAAGCGGAACATTAACAAAAATACCGCGATCCCGTAGGTCCCTTCGCAGGGCCAGCTGAAC
ATAATCGTGCAGGTCTGCACGGACCAGCGCGGCCACTTCCCCGCCAGGAACCATGACAAAAGAACCCACA
CTGATTATGACACGCATACTCGGAGCTATGCTAACCAGCGTAGCCCCGATGTAAGCTTGTTGCATGGGCG
GCGATATAAAATGCAAGGTACTGCTCAAAAAATCAGGCAAAGCCTCGCGCAAAAAGCAAGCACATCGTA
GTCATGCTCATGCAGATAAAGGCAGGTAAGTTCCGGAACCACCACAGAAAAGACACCATTTTCTCTCA
AACATGTCTGCGGGTTCCTGCATAAACACAAAATAAATAACAAAAAAAAAAAAACATTTAAACATTAGA
AGCCTGTCTTACAACAGGAAAAACAACCCTTATAAGCATAAGACGGACTACGGCCATGCCGGCGTGACCG
TAAAAAAACTGGTCACCGTGATTAAAAAGCACCACCGACAGTTCCTCGGTCATGTCCGGAGTCATAATGT
AAGACTCGGTAAACACATCAGGTTGGTTAACATCGGTCAGTGCTAAAAAGCGACCGAAATAGCCCGGGGG
AATACATACCCGCAGGCGTAGAGACAACATTACAGCCCCATAGGAGGTATAACAAAATTAATAGGAGAG
AAAAACACATAAACCCCTGAAAAACCCTCCTGCCCCTAGGCAAAATAGCACCCTCCCGCTCCAGAACAAC
ATACAGCGCTTCCACAGCGGCAGCCATAACAGTCAGCCTTACCAGTAAAAAACCTATTAAAAACACCA
CTCGACACGGCACCAGCTCAATCAGTCACAGTGTAAAAGGGCCAAGTACAGAGCGAGTATATAGGAC
TAAAAAATGACGTAACGGTTAAAGTCCACAAAAACCACCCAGAAACCGCACGCGAACCTACGCCCAGAA
ACGAAAGCCAAAAAACCCACAACTTCCTCAAATCTTCACTTCCGTTTTCCCACGATACGTCACTTCCCAT
TTTAAAAAAAAACTACAATTCCCAATACATGCAAGTTACTCCGCCCTAAAACCTACGTCACCCGCCCCGT
TCCCACGCCCCGCGCCACGTCACAAACTCCACCCCCTCATTATCATATTGGCTTCAATCCAAAATAAGGT
ATATTATTGATGATGGCGAT
```

FIG. 63 (continued)

SEQ ID NO:39

```
CGCCATCATCAATAATATACCTTATTTTGGATTGAAGCCAATATGATAATGAGGGGGTGGAGTTTGTGAC
GTGGCGCGGGGCGTGGGAACGGGGCGGGTGACGTAGTAGTGTGGCGGAAGTGTGATGTTGTAAGTGTGGC
GGAACACATGTAAGCGCCGGATGTGGTAAAAGTGACGTTTTGGTGTGCGCCGGTGTACACGGGAAGTGA
CAATTTTCGCGCGGTTTTAGGCGGATGTTGTAGTAAATTTGGGCGTAACCAAGTAATATTTGGCCATTTT
CGCGGGAAAACTGAATAAGAGGAAGTGAAATCTGAATAATTCTGTGTTACTCATAGCGCGTAATATTTGT
CTAGGGCCGCGGGGACTTTGACCGTTTACGTGGAGACTCGCCCAGGTGTTTTCTCAGGTGTTTTCCGCG
TTCCGGGTCAAAGTTGGCGTTTTATTATTATAGTCAGCTGACGCGCAGTGTATTTATACCCGGTGAGTTC
CTCAAGAGGCCACTCTTGAGTGCCAGCGAGTAGAGTTTTCTCCTCCGAGCCGCTCCGACACCGGGACTGA
AAATGAGACATATTATCTGCCACGGAGGTGTTATTACCGAAGAAATGGCCGCCAGTCTTTTGGACCAGCT
GATCGAAGAGGTACTGGCTGATAATCTTCCACCTCCTAGCCATTTTGAACCACCTACCCTTCACGAACTG
TATGATTTAGACGTGACGGCCCCCGAAGATCCCAACGAGGAGGCGGTTTCGCAGATTTTTCCCGAGTCTG
TAATGTTGGCGGTGCAGGAAGGGATTGACTTATTCACTTTTCCGCCGGCGCCCGGTTCTCCGGAGCCGCC
TCACCTTTCCCGGCAGCCCGAGCAGCCGGAGCAGAGAGCCTTGGGTCCGGTTCTATGCCAAACCTTGTG
CCGGAGGTGATCGATCTTACCTGCCACGAGGCTGGCTTTCCACCCAGTGACGACGAGGATGAAGAGGGTG
AGGAGTTTGTGTTAGATTATGTGGAGCACCCCGGGCACGGTTGCAGGTCTTGTCATTATCACCGGAGGAA
TACGGGGACCCAGATATTATGTGTTCGCTTTGCTATATGAGGACCTGTGGCATGTTTGTCTACAGTAAG
TGAAAAATTATGGGCAGTGGGTGATAGAGTGGTGGGTTTGGTGTGGTAATTTTTTTTTAATTTTTACAG
TTTTGTGGTTTAAAGAATTTTGTATTGTGATTTTTAAAAGGTCCTGTGTCTGAACCTGAGCCTGAGCCC
GAGCCAGAACCGGAGCCTGCAAGACCTACCCGGCGTCCTAAATTGGTGCCTGCTATCCTGAGACGCCCGA
CATCACCTGTGTCTAGAGAATGCAATAGTAGTACGGATAGCTGTGACTCCGGTCCTTCTAACACACCTCC
TGAGATACACCCGGTGGTCCCGCTGTGCCCCATTAAACCAGTTGCCGTGAGAGTTGGTGGGCGTCGCCAG
GCTGTGGAATGTATCGAGGACTTGCTTAACGAGTCTGGGCAACCTTTGGACTTGAGCTGTAAACGCCCCA
GGCCATAAGGTGTAAACCTGTGATTGCGTGTGTGGTTAACGCCTTTGTTTGCTGAATGAGTTGATGTAAG
TTTAATAAAGGGTGAGATAATGTTTAACTTGCATGGCGTGTTAAATGGGGCGGGGCTTAAAGGGTATATA
ATGCGCCGTGGGCTAATCTTGGTTACATCTGACCTCATGGAGGCTTGGGAGTGTTTGGAAGATTTTCTG
CTGTGCGTAACTTGCTGGAACAGAGCTCTAACAGTACCTCTTGGTTTTGGAGGTTTCTGTGGGGCTCCTC
CCAGGCAAAGTTAGTCTGCAGAATTAAGGAGGATTACAAGTGGGAATTTGAAGAGCTTTTGAAATCCTGT
GGTGAGCTGTTTGATTCTTTGAATCTGGGTCACCAGGCGCTTTTCCAAGAGAAGGTCATCAAGACTTTGG
ATTTTTCCACACCGGGGCGCGCTGCGGCTGCTGTTGCTTTTTTGAGTTTTATAAAGGATAAATGGAGCGA
AGAAACCCATCTGAGCGGGGGGTACCTGCTGGATTTTCTGGCCATGCATCTGTGGAGAGCGGTGGTGAGA
CACAAGAATCGCCTGCTACTGTTGTCTTCCGTCCGCCCGGCAATAATACCGACGGAGGAGCAACAGCAGG
AGGAAGCCAGGCGGCGGCGGCGGCAGGAGCAGAGCCCATGGAACCCGAGAGCCGGCCTGGACCCTCGGGA
ATGAATGTTGTACAGGTGGCTGAACTGTTTCCAGAACTGAGACGCATTTTAACCATTAACGAGGATGGGC
AGGGGCTAAAGGGGTAAAGAGGGAGCGGGGGCTTCTGAGGCTACAGAGGAGGCTAGGAATCTAACTTT
TAGCTTAATGACCAGACACCGTCCTGAGTGTGTTACTTTTCAGCAGATTAAGGATAATTGCGCTAATGAG
CTTGATCTGCTGGCGCAGAAGTATTCCATAAAGCAGCTGACCACTTACTGGCTGCAGCCAGGGGATGATT
TTGAGGAGGCTATTAGGGTATATGCAAAGGTGGCACTTAGGCCAGATTGCAAGTACAAGATTAGCAAACT
TGTAAATATCAGGAATTGTTGCTACATTTCTGGGAACGGGGCCGAGGTGGAGATAGATACGGAGGATAGG
GTGGCCTTTAGATGTAGCATGATAAATATGTGGCCGGGGTGCTTGGCATGGACGGGTGGTTATTATGA
ATGTGAGGTTTACTGGTCCCAATTTTAGCGGTACGGTTTTCCTGGCCAATACCAATCTTATCCTACACGG
TGTAAGCTTCTATGGGTTTAACAATACCTGTGTGGAAGCCTGGACCGATGTAAGGGTTCGGGCTGTGCC
TTTTACTGCTGCTGGAAGGGGGTGGTGTGTCGCCCAAAAGCAGGGCTTCAATTAAGAAATGCCTGTTTG
AAAGGTGTACCTTGGGTATCCTGTCTGAGGGTAACTCCAGGGTGCGCCACAATGTGGCCTCCGACTGTGG
TTGCTTTATGCTAGTGAAAAGCGTGGCTGTGATTAAGCATAACATGGTGTGTGGCAACTGCGAGGACAGG
GCCTCTCAGATGCTGACCTGCTCGGACGGCAACTGTCACTTGCTGAAGACCATTCACGTAGCCAGCCACT
CTCGCAAGGCCTGGCCAGTGTTTGAGCACAACATACTGACCCGCTGTTCCTTGCATTTGGGTAACAGGAG
GGGGGTGTTCCTACCTTACCAATGCAATTTGAGTCACACTAAGATATTGCTTGAGCCCGAGAGCATGTCC
AAGGTGAACCTGAACGGGGTGTTTGACATGACCATGAAGATCTGGAAGGTGCTGAGGTACGATGAGACCC
GCACCAGGTGCAGACCCTGCGAGTGTGGCGGTAAACATATTAGGAACCAGCCTGTGATGCTGGATGTGAC
```

FIG. 64

SEQ ID NO:39 (continued)

```
CGAGGAGCTGAGGCCCGATCACTTGGTGCTGGCCTGCACCCGCGCTGAGTTTGGCTCTAGCGATGAAGAT
ACAGATTGAGGTACTGAAATGTGTGGGCGTGGCTTAAGGGTGGGAAGAATATATAAGGTGGGGGTCTCA
TGTAGTTTTGTATCTGTTTTGCAGCAGCCGCCGCCATGAGCGCCAACTCGTTTGATGGAAGCATTGTGAG
CTCATATTTGACAACGCGCATGCCCCCATGGGCCGGGGTGCGTCAGAATGTGATGGGCTCCAGCATTGAT
GGTCGCCCCGTCCTGCCCGCAAACTCTACTACCTTGACCTACGAGACCGTGTCTGGAACGCCGTTGGAGA
CTGCAGCCTCCGCCGCCGCTTCAGCCGCTGCAGCCACCGCCCGCGGGATTGTGACTGACTTTGCTTTCCT
GAGCCCGCTTGCAAGCAGTGCAGCTTCCCGTTCATCCGCCCGCGATGACAAGTTGACGGCTCTTTTGGCA
CAATTGGATTCTTTGACCCGGGAACTTAATGTCGTTTCTCAGCAGCTGTTGGATCTGCGCCAGCAGGTTT
CTGCCCTGAAGGCTTCCTCCCCTCCCAATGCGGTTTAAAACATAAATAAAAACCAGACTCTGTTTGGATT
TGGATCAAGCAAGTGTCTTGCTGTCTTTATTTAGGGGTTTTGCGCGCGCGGTAGGCCCGGGACCAGCGGT
CTCGGTCGTTGAGGGTCCTGTGTATTTTTTCCAGGACGTGGTAAAGGTGACTCTGGATGTTCAGATACAT
GGGCATAAGCCCGTCTCTGGGGTGGAGGTAGCACCACTGCAGAGCTTCATGCTGCGGGGTGGTGTTGTAG
ATGATCCAGTCGTAGCAGGAGCGCTGGGCGTGGTGCCTAAAAATGTCTTTCAGTAGCAAGCTGATTGCCA
GGGGCAGGCCCTTGGTGTAAGTGTTTACAAAGCGGTTAAGCTGGGATGGGTGCATACGTGGGGATATGAG
ATGCATCTTGGACTGTATTTTTAGGTTGGCTATGTTCCCAGCCATATCCCTCCGGGGATTCATGTTGTGC
AGAACCACCAGCACAGTGTATCCGGTGCACTTGGGAAATTTGTCATGTAGCTTAGAAGGAAATGCGTGGA
AGAACTTGGAGACGCCCTTGTGACCTCCAAGATTTTCCATGCATTCGTCCATAATGATGGCAATGGGCCC
ACGGGCGGCGGCCTGGGCGAAGATATTTCTGGGATCACTAACGTCATAGTTGTGTTCCAGGATGAGATCG
TCATAGGCCATTTTTACAAAGCGCGGGCGGAGGGTGCCAGACTGCGGTATAATGGTTCCATCCGGCCCAG
GGGCGTAGTTACCCTCACAGATTTGCATTTCCCACGCTTTGAGTTCAGATGGGGGGATCATGTCTACCTG
CGGGGCGATGAAGAAAACCGTTTCCGGGGTAGGGGAGATCAGCTGGGAAGAAAGCAGGTTCCTAAGCAGC
TGCGACTTACCGCAGCCGGTGGGCCCGTAAATCACACCTATTACCGGCTGCAACTGGTAGTTAAGAGAGC
TGCAGCTGCCGTCATCCCTGAGCAGGGGGCCACTTCGTTAAGCATGTCCCTGACTTGCATGTTTTCCCT
GACCAAATCCGCCAGAAGGCGCTCGCCGCCCAGCGATAGCAGTTCTTGCAAGGAAGCAAAGTTTTTCAAC
GGTTTGAGGCCGTCCGCCGTAGGCATGCTTTTGAGCGTTTGACCAAGCAGTTCCAGGCGGTCCCACAGCT
CGGTCACGTGCTCTACGGCATCTCGATCCAGCATATCTCCTCGTTTCGCGGGTTGGGGCGGCTTTCGCTG
TACGGCAGTAGTCGGTGCTCGTCCAGACGGGCCAGGGTCATGTCTTTCCACGGGCGCAGGGTCCTCGTCA
GCGTAGTCTGGGTCACGGTGAAGGGGTGCGCTCCGGGTTGCGCGCTGGCCAGGGTGCGCTTGAGGCTGGT
CCTGCTGGTGCTGAAGCGCTGCCGGTCTTCGCCCTGCGCGTCGGCCAGGTAGCATTTGACCATGGTGTCA
TAGTCCAGCCCCTCCGCGGCGTGGCCCTTGGCGCGCAGCTTGCCCTTGGAGGAGGCGCCGCACGAGGGGC
AGTGCAGACTTTTAAGGGCGTAGAGCTTGGGCGCGAGAAATACCGATTCCGGGGAGTAGGCATCCGCGCC
GCAGGCCCCGCAGACGGTCTCGCATTCCACGAGCCAGGTGAGCTCTGGCCGTTCGGGGTCAAAAACCAGG
TTTCCCCCATGCTTTTTGATGCGTTTCTTACCTCTGGTTTCCATGAGCCGGTGTCCACGCTCGGTGACGA
AAAGGCTGTCCGTGTCCCCGTATACAGACTTGAGAGGCCTGTCCTCGAGCGGTGTTCCGCGGTCCTCCTC
GTATAGAAACTCGGACCACTCTGAGACGAAGGCTCGCGTCCAGGCCAGCACGAAGGAGGCTAAGTGGGAG
GGGTAGCGGTCGTTGTCCACTAGGGGGTCCACTCGCTCCAGGGTGTGAAGACACATGTCGCCCTCTTCGG
CATCAAGGAAGGTGATTGGTTTATAGGTGTAGGCCACGTGACCGGGTGTTCCTGAAGGGGGCTATAAAA
GGGGGTGGGGGCGCGTTCGTCCTCACTCTCTTCCGCATCGCTGTCTGCGAGGGCCAGCTGTTGGGGTGAG
TACTCCCTCTCAAAAGCGGGCATGACTTCTGCGCTAAGATTGTCAGTTTCCAAAAACGAGGAGGATTTGA
TATTCACCTGGCCCGCGGTGATGCCTTTGAGGGTGGCCGCGTCCATCTGGTCAGAAAAGACAATCTTTTT
GTTGTCAAGCTTGGTGGCAAACGACCCGTAGAGGGCGTTGGACAGCAACTTGGCGATGGAGCGCAGGGTT
TGGTTTTTGTCGCGATCGGCGCGCTCCTTGGCCGCGATGTTTAGCTGCACGTATTCGCGCGCAACGCACC
GCCATTCGGGAAGACGGTGGTGCGCTCGTCGGGCACTAGGTGCACGCGCCAACCGCGGTTGTGCAGGGT
GACAAGGTCAACGCTGGTGGCTACCTCTCCGCGTAGGCGCTCGTTGGTCCAGCAGAGGCGGCCGCCCTTG
CGCGAGCAGAATGGCGGTAGTGGGTCTAGCTGCGTCTCGTCCGGGGGTCTGCGTCCACGGTAAAGACCC
CGGGCAGCAGGCGCGCGTCGAAGTAGTCTATCTTGCATCCTTGCAAGTCTAGCGCCTGCTGCCATGCGCG
GGCGGCAAGCGCGCGCTCGTATGGGTTGAGTGGGGACCCCATGGCATGGGTGGGTGAGCGCGGAGGCG
TACATGCCGCAAATGTCGTAAACGTAGAGGGCTCTCTGAGTATTCCAAGATATGTAGGGTAGCATCTTC
CACCGCGGATGCTGGCGCGCACGTAATCGTATAGTTCGTGCGAGGGAGCGAGGAGGTCGGGACCGAGGTT
GCTACGGGCGGGCTGCTCTGCTCGGAAGACTATCTGCCTGAAGATGGCATGTGAGTTGGATGATATGGTT
GGACGCTGGAAGACGTTGAAGCTGGCGTCTGTGAGACCTACCGCGTCACGCACGAAGGAGGCGTAGGAGT
CGCGCAGCTTGTTGACCAGCTCGGCGGTGACCTGCACGTCTAGGGCGCAGTAGTCCAGGGTTTCCTTGAT
```

FIG. 64 (continued)

SEQ ID NO:39 (continued)

```
GATGTCATACTTATCCTGTCCCTTTTTTTTCCACAGCTCGCGGTTGAGGACAAACTCTTCGCGGTCTTTC
CAGTACTCTTGGATCGGAAACCCGTCGGCCTCCGAACGGTAAGAGCCTANCATGTAGAACTGGTTGACGG
CCTGGTAGGCGCAGCATCCCTTTTCTACGGGTAGCGCGTATGCCTGCGCGGCCTTCCGGAGCGAGGTGTG
GGTGAGCGCAAAGGTGTCCCTAACCATGACTTTGAGGTACTGGTATTTGAAGTCAGTGTCGTCGCATCCG
CCCTGCTCCCAGAGCAAAAAGTCCGTGCGCTTTTTGGAACGCGGGTTTGGCAGGGCGAAGGTGACATCGT
TGAAGAGTATCTTTCCCGCGCGAGGCATAAAGTTGCGTGTGATGCGGAAGGGTCCCGGCACCTCGGAACG
GTTGTTAATTACCTGGGCGGCGAGCACGATCTCGTCAAAGCCGTTGATGTTGTGGCCCACAATGTAAAGT
TCCAAGAAGCGCGGGATGCCCTTGATGGAAGGCAATTTTTTAAGTTCCTCGTAGGTGAGCTCTTCAGGGG
AGCTGAGCCCGTGCTCTGAAAGGGCCCAGTCTGCAAGATGAGGGTTGGAAGCGACGAATGAGCTCCACAG
GTCACGGGCCATTAGCATTTGCAGGTGGTCGCGAAAGGTCCTAAACTGGCGACCTATGGCCATTTTTTCT
GGGGTGATGCAGTAGAAGGTAAGCGGGTCTTGTTCCCAGCGGTCCCATCCAAGGTCCGCGGCTAGGTCTC
GCGCGGCGGTCACTAGAGGCTCATCTCCGCCGAACTTCATGACCAGCATGAAGGGCACGAGCTGCTTCCC
AAAGGCCCCCATCCAAGTATAGGTCTCTACATCGTAGGTGACAAAGAGACGCTCGGTGCGAGGATGCGAG
CCGATCGGGAAGAACTGGATCTCCCGCCACCAGTTGGAGGAGTGGCTGTTGATGTGGTGAAAGTAGAAGT
CCCTGCGACGGGCCGAACACTCGTGCTGGCTTTTGTAAAAACGTGCGCAGTACTGGCAGCGGTGCACGGG
CTGTACATCCTGCACGAGGTTGACCTGACGACCGCGCACAAGGAAGCAGAGTGGGAATTTGAGCCCCTCG
CCTGGCGGGTTTGGCTGGTGGTCTTCTACTTCGGCTGCTTGTCCTTGACCGTCTGGCTGCTCGAGGGGAG
TTACGGTGGATCGGACCACCACGCCGCGCGAGCCCAAAGTCCAGATGTCCGCGCGCGGCGGTCGGAGCTT
GATGACAACATCGCGCAGATGGGAGCTGTCCATGGTCTGGAGCTCCCGCGGCGTCAGGTCAGGCGGGAGC
TCCTGCAGGTTTACCTCGCATAGCCGGGTCAGGGCGCGGGCTAGGTCCAGGTGATACCTGATTTCCAGGG
GCTGGTTGGTGGCGGCGTCGATGGCTTGCAAGAGGCCGCATCCCCGCGGCGCGACTACGGTACCGCGCGG
CGGGCGGTGGGCCGCGGGGTGTCCTTGGATGATGCATCTAAAAGCGGTGACGCGGGCGGGCCCCCGGAG
GTAGGGGGGGCTCGGGACCCGCCGGGAGAGGGGGCAGGGGCACGTCGGCGCCGCGCGGGCAGGAGCTG
GTGCTGCGCGGAGGTTGCTGGCGAACGCGACGACGCGGCGGTTGATCTCCTGAATCTGGCGCCTCTGC
GTGAAGACGACGGGCCCGGTGAGCTTGAACCTGAAAGAGAGTTCGACAGAATCAATTTCGGTGTCGTTGA
CGGCGGCCTGGCGCAAAATCTCCTGCACGTCTCCTGAGTTGTCTTGATAGGCGATCTCGGCCATGAACTG
CTCGATCTCTTCCTCCTGGAGATCTCCGCGTCCGGCTCGCTCCACGGTGGCGGCGAGGTCGTTGGAGATG
CGGGCCATGAGCTGCGAGAAGGCGTTGAGGCCTCCCTCGTTCCAGACGCGGCTGTAGACCACGCCCCCTT
CGGCATCGCGGGCGCGCATGACCACCTGCGCGAGATTGAGCTCCACGTGCCGGGCGAAGACGGCGTAGTT
TCGCAGGCGCTGAAAGAGGTAGTTGAGGGTGGTGGCGGTGTGTTCTGCCACGAAGAAGTACATAACCCAG
CGCCGCAACGTGGATTCGTTGATATCCCCCAAGGCCTCAAGGCGCTCCATGGCCTCGTAGAAGTCCACGG
CGAAGTTGAAAAACTGGGAGTTGCGCGCCGACACGGTTAACTCCTCCTCCAGAAGACGGATGAGCTCGGC
GACAGTGTCGCGCACCTCGCGCTCAAAGGCTACAGGGGCCTCTTCTTCTTCTTCAATCTCCTCTTCCATA
AGGGCCTCCCCTTCTTCTTCTTCTGGCGGCGGTGGGGGAGGGGGGACACGGCGGCGACGACGGCGCACCG
GGAGGCGGTCGACAAAGCGCTCGATCATCTCCCCGCGGCGACGGCGCATGGTCTCGGTGACGGCGCGGCC
GTTCTCGCGGGGCGCAGTTGGAAGACGCCGCCCGTCATGTCCCGGTTATGGGTTGGCGGGGGGCTGCCG
TGCGGCAGGGATACGGCGCTAACGATGCATCTCAACAATTGTTGTGTAGGTACTCCGCCACCGAGGGACC
TGAGCGAGTCCGCATCGACCGGATCGGAAAACCTCTCGAGAAAGGCGTCTAACCAGTCACAGTCGCAAGG
TAGGCTGAGCACCGTGGCGGGCGGCAGCGGGCGGCGGTCGGGGTTGTTTCTGGCGGAGGTGCTGCTGATG
ATGTAATTAAAGTAGGCGGTCTTGAGACGGCGGATGGTCGACAGAAGCACCATGTCCTTGGGTCCGGCCT
GCTGAATGCGCAGGCGGTCGGCCATGCCCCAGGCTTCGTTTTGACATCGGCGCAGGTCTTTGTAGTAGTC
TTGCATGAGCCTTTCTACCGGCACTTCTTCTTCTCCTTCCTCTTGTCCTGCATCTCTTGCATCTATCGCT
GCGGCGGCGGCGGAGTTTGGCCGTAGGTGGCGCCCTCTTCCTCCCATGCGTGTGACCCCGAAGCCCCTCA
TCGGCTGAAGCAGGGCCAGGTCGGCGACAACGCGCTCGGCTAATATGGCCTGCTGCACCTGCGTGAGGGT
AGACTGGAAGTCGTCCATGTCCACAAAGCGGTGGTATGCGCCCGTGTTGATGGTGTAAGTGCAGTTGGCC
ATAACGGACCAGTTAACGGTCTGGTGACCCGGCTGCGAGAGCTCGGTGTACCTGAGACGCGAGTAAGCCC
TTGAGTCAAAGACGTAGTCGTTGCAAGTCCGCACCAGGTACTGGTATCCCACCAAAAAGTGCGGCGGCGG
CTGGCGGTAGAGGGGCCAGCGTAGGGTGGCCGGGGCTCCGGGGCGAGGTCTTCCAACATAAGGCGATGA
TATCCGTAGATGTACCTGGACATCCAGGTGATGCCGGCGGCGGTGGTGGAGGCGCGCGGAAAGTCACGGA
CGCGGTTCCAGATGTTGCGCAGCGGCAAAAAGTGCTCCATGGTCGGGACGCTCTGGCCGGTCAGGCGCGC
GCAGTCGTTGACGCTCTAGACCGTGCAAAAGGAGAGCCTGTAAGCGGGCACTCTTCCGTGGTCTGGTGGA
TAAATTCGCAAGGGTATCATGGCGGACGACCGGGGTTCGAACCCCGGATCCGGCCGTCCGCCGTGATCCA
```

FIG. 64 (continued)

SEQ ID NO:39 (continued)

```
TGCGGTTACCGCCCGCGTGTCGAACCCAGGTGTGCGACGTCAGACAACGGGGGAGCGCTCCTTTTGGCTT
CCTTCCAGGCGCGGCGGATGCTGCGCTAGCTTTTTTGGCCACTGGCCGCGCGCGGCGTAAGCGGTTAGGC
TGGAAAGCGAAAGCATTAAGTGGCTCGCTCCCTGTAGCCGGAGGGTTATTTTCCAAGGGTTGAGTCGCGG
GACCCCCGGTTCGAGTCTCGGGCCGGCCGGACTGCGGCGAACGGGGGTTTGCCTCCCCGTCATGCAAGAC
CCCGCTTGCAAATTCCTCCGGAAACAGGGACGAGCCCCTTTTTTGCTTTTCCCAGATGCATCCGGTGCTG
CGGCAGATGCGCCCCCTCCTCAGCAGCGGCAAGAGCAAGAGCAGCGGCAGACATGCAGGGCACCCTCCC
CTCCTCCTACCGCGTCAGGAGGGGCGACATCCGCGGTTGACGCGGCAGCAGATGGTGATTACGAACCCCC
GCGGCGCCGGGCCCGGCACTACCTGGACTTGGAGGAGGGCGAGGGCCTGGCGCGGCTAGGAGCGCCCTCT
CCTGAGCGGTACCCAAGGGTGCAGCTGAAGCGTGATACGCGTGAGGCGTACGTGCCGCGGCAGAACCTGT
TTCGCGACCGCGAGGGAGAGGAGCCCGAGGAGATGCGGGATCGAAAGTTCCACGCAGGGCGCGAGCTGCG
GCATGGCCTGAATCGCGAGCGGTTGCTGCGCGAGGAGGACTTTGAGCCCGACGCGCGAACCGGGATTAGT
CCCGCGCGCACACGTGGCGGCCGCCGACCTGGTAACCGCATACGAGCAGACGGTGAACCAGGAGATTA
ACTTTCAAAAAGCTTTAACAACCACGTGCGTACGCTTGTGGCGCGCGAGGAGGTGGCTATAGGACTGAT
GCATCTGTGGGACTTTGTAAGCGCGCTGGAGCAAAACCCAAATAGCAAGCCGCTCATGGCGCAGCTGTTC
CTTATAGTGCAGCACAGCAGGGACAACGAGGCATTCAGGGATGCGCTGCTAAACATAGTAGAGCCCGAGG
GCCGCTGGCTGCTCGATTTGATAAACATCCTGCAGAGCATAGTGGTGCAGGAGCGCAGCTTGAGCCTGGC
TGACAAGGTGGCCGCCATCAACTATTCCATGCTTAGCCTGGGCAAGTTTTACGCCCGCAAGATATACCAT
ACCCCTTACGTTCCCATAGACAAGGAGGTAAAGATCGAGGGGTTCTACATGCGCATGGCGCTGAAGGTGC
TTACCTTGAGCGACGACCTGGGCGTTTATCGCAACGAGCGCATCCACAAGGCCGTGAGCGTGAGCCGGCG
GCGCGAGCTCAGCGACCGCGAGCTGATGCACAGCCTGCAAAGGGCCCTGGCTGGCACGGGCAGCGGCGAT
AGAGAGGCCGAGTCCTACTTTGACGCGGGCGCTGACCTGCGCTGGGCCCCAAGCCGACGCGCCCTGGAGG
CAGCTGGGGCCGGACCTGGGCTGGCGGTGGCACCCGCGCGCGCTGGCAACGTCGGCGGCGTGGAGGAATA
TGACGAGGACGATGAGTACGAGCCAGAGGACGGCGAGTACTAAGCGGTGATGTTTCTGATCAGTCGCGGC
CGCGATATCGCTAGCGAAGTTCCTATTCTCTAGAAAGTATAGGAACTTCGGATCCTCTAGAGTCGAAAAA
AAAAAAGCATGATGCAAAATAAAAAACTCACCAAGGCCATGGCACCGAGCGTTGGTTTTCTTGTATTCCC
CTTAGTATGCGGCGCGCGGCGATGTATGAGGAAGGTCCTCCTCCCTCCTACGAGAGTGTGGTGAGCGCGG
CGCCAGTGGCGGCGGCGCTGGGTTCTCCCTTCGATGCTCCCCTGGACCCGCCGTTTGTGCCTCCGCGGTA
CCTGCGGCCTACCGGGGGAGAAACAGCATCCGTTACTCTGAGTTGGCACCCCTATTCGACACCACCCGT
GTGTACCTGGTGGACAACAAGTCAACGGATGTGGCATCCCTGAACTACCAGAACGACCACAGCAACTTTC
TGACCACGGTCATTCAAAACAATGACTACAGCCCGGGGGAGGCAAGCACACAGACCATCAATCTTGACGA
CCGGTCGCACTGGGGCGGCGACCTGAAAACCATCCTGCATACCAACATGCCAAATGTGAACGAGTTCATG
TTTACCAATAAGTTTAAGGCGCGGGTGATGGTGTCGCGCTTGCCTACTAAGGACAATCAGGTGGAGCTGA
AATACGAGTGGGTGGAGTTCACGCTGCCCGAGGGCAACTACTCCGAGACCATGACCATAGACCTTATGAA
CAACGCGATCGTGGAGCACTACTTGAAAGTGGGCAGACAGAACGGGGTTCTGGAAAGCGACATCGGGGTA
AAGTTTGACACCCGCAACTTCAGACTGGGGGTTTGACCCCGTCACTGGTCTTGTCATGCCTGGGGTATATA
CAAACGAAGCCTTCCATCCAGACATCATTTTGCTGCCAGGATGCGGGGTGGACTTCACCCACAGCCGCCT
GAGCAACTTGTTGGGCATCCGCAAGCGGCAACCCTTCCAGGAGGGCTTTAGGATCACCTACGATGATCTG
GAGGGTGGTAACATTCCCGCACTGTTGGATGTGGACGCCTACCAGGCGAGCTTGAAAGATGACACCGAAC
AGGGCGGGGGTGGCGCAGGCGGCAGCAACAGCAGTGGCAGCGGCGCGGAAGAGAACTCCAACGCGGCAGC
CGCGGCAATGCAGCCGGTGGAGGACATGAACGATCATGCCATTCGCGGCGACACCTTTGCCACACGGGCT
GAGGAGAAGCGCGCTGAGGCCGAAGCAGCGGCCGAAGCTGCCGCCCCGCTGCGCAACCCGAGGTCGAGA
AGCCTCAGAAGAAACCGGTGATCAAACCCCTGACAGAGGACAGCAAGAAACGCAGTTACAACCTAATAAG
CAATGACAGCACCTTCACCCAGTACCGCAGCTGGTACCTTGCATACAACTACGGCGACCCTCAGACCGGA
ATCCGCTCATGGACCCTGCTTTGCACTCCTGACGTAACCTGCGGCTCGGAGCAGGTCTACTGGTCGTTGC
CAGACATGATGCAAGACCCCGTGACCTTCCGCTCCACGCGCCAGATCAGCAACTTTCCGGTGGTGGGCGC
CGAGCTGTTGCCCGTGCACTCCAAGAGCTTCTACAACGACCAGGCCGTCTACTCCCAACTCATCCGCCAG
TTTACCTCTCTGACCCACGTGTTCAATCGCTTTCCCGAGAACCAGATTTTGGCGCGCCCGCCAGCCCCA
CCATCACCACCGTCAGTGAAAACGTTCCTGCTCTCACAGATCACGGGACGCTACCGCTGCGCAACAGCAT
CGGAGGAGTCCAGCGAGTGACCATTACTGACGCCAGACGCCGCACCTGCCCCTACGTTTACAAGGCCCTG
GGCATAGTCTCGCCGCGCGTCCTATCGAGCCGCACTTTTTGAGCAAGCATGTCCATCCTTATATCGCCCA
GCAATAACACAGGCTGGGGCCTGCGCTTCCCAAGCAAGATGTTTGGCGGGGCCAAGAAGCGCTCCGACCA
ACACCCAGTGCGCGTGCGCGGGCACTACCGCGCGCCCTGGGGCGCGCACAAACGCGGCCGCACTGGGCGC
```

FIG. 64 (continued)

SEQ ID NO:39 (continued)

```
ACCACCGTCGATGACGCCATCGACGCGGTGGTGGAGGAGGCGCGCAACTACACGCCCACGCCGCCGCCAG
TGTCCACCGTGGACGCGGCCATTCAGACCGTGGTGCGCGGAGCCCGGCGCTACGCTAAAATGAAGAGACG
GCGGAGGCGCGTAGCACGTCGCCACCGCCGCCGACCCGGCACTGCCGCCCAACGCGCGGCGGCGGCCCTG
CTTAACCGCGCACGTCGCACCGGCCGACGGGCGGCCATGCGAGCCGCTCGAAGGCTGGCCGCGGGTATTG
TCACTGTGCCCCCAGGTCCAGGCGACGAGCGGCCGCCGCAGCAGCCGCGGCCATTAGTGTTATGACTCA
GGGTCGCAGGGGCAACGTGTACTGGGTGCGCGACTCGGTTAGCGGCCTGCGCGTGCCCGTGCGCACCCGC
CCCCCGCGCAACTAGATTGCAATAAAAAACTACTTAGACTCGTACTGTTGTATGTATCCAGCGGCGGCGG
CGCGCATCGAAGCTATGTCCAAGCGCAAAATCAAAGAAGAGATGCTCCAGGTCATCGCGCCGGAGATCTA
TGGCCCCCCGAAGAAGGAAGAGCAGGATTACAAGCCCCGAAAGCTAAAGCGGGTCAAAAAGAAAAAGAAA
GATGATGATGATGATGAACTTGACGACGAGGTGGAACTGTTGCACGCGACCGCGCCCAGGCGACGGGTAC
AGTGGAAAGGTCGACGCGTAAGACGTGTTTTGCGACCCGGCACCACCGTAGTCTTTACGCCCGGTGAGCG
CTCCACCCGCACCTACAAGCGCGTGTATGATGAGGTGTACGGCGACGAGGACCTGCTTGAGCAGGCCAAC
GAGCGCCTCGGGGAGTTTGCCTACGGAAAGCGGCATAAGGACATGCTGGCGTTGCCGCTGGACGAGGGCA
ACCCAACACCTAGCCTAAAGCCCGTGACACTGCAGCAGGTGCTGCCCGCGCTTGCACCGTCCGAAGAAAA
GCGCGGCCTAAAGCGCGAGTCTGGTGACTTGGCACCCACCGTGCAGCTGATGGTACCCAAGCGTCAGCGA
CTGGAAGATGTCTTGGAAAAAATGACCGTGGAGCCTGGGCTGGAGCCCGAGGTCCGCGTGCGGCCAATCA
AGCAGGTGGCACCGGGACTGGGCGTGCAGACCGTGGACGTTCAGATACCCACCACCAGTAGCACTAGTAT
TGCCACTGCCACAGAGGGCATGGAGACACAAACGTCCCCGGTTGCCTCGGCGGTGGCAGATGCCGCGGTG
CAGGCGGCCGCTGCGGCCGCGTCCAAGACCTCTACGGAGGTGCAAACGGACCCGTGGATGTTTCGTGTTT
CAGCCCCCCGGCGTCCGCGCCGTTCAAGGAAGTACGGCGCCGCCAGCGCGCTACTGCCCGAATATGCCCT
ACATCCTTCCATCGCGCCTACCCCGGCTATCGTGGCTACACCTACCGCCCAGAAGACGAGCAACTACC
CGACGCCGAACCACCACTGGAACCCGCCGCCGCCGTCGCCGTCGCCAGCCCGTGCTGGCCCCGATTTCCG
TGCGCAGGGTGGCTCGCGAAGGAGGCAGGACCCTGGTGCTGCCAACAGCGCGCTACCACCCCAGCATCGT
TTAAAAGCCGGTCTTTGTGGTTCTTGCAGATATGGCCCTCACCTGCCGCCTCCGTTTCCGGTGCCGGGA
TTCCGAGGAAGAATGCACCGTAGGAGGGGCATGGCCGGCCACGGCCTGACGGGCGGCATGCGTCGTGCGC
ACCACCGGCGGCGGCGCGTCGCACCGTCGCATGCGCGCCGGTATCCTGCCCCTCCTTATTCCACTGAT
CGCCGCGGCGATTGGCGCCGTGCCCGGAATTGCATCCGTGGCCTTGCAGGCGCAGAGACACTGATTAAAA
ACAAGTTACATGTGGAAAAATCAAAATAAAAGTCTGGACTCTCACGCTCGCTTGGTCCTGTAACTATTTT
GTAGAATGGAAGACATCAACTTTGCGTCACTGGCCCCGCGACACGGCTCGCGCCCGTTCATGGGAAACTG
GCAAGATATCGGCACCAGCAATATGAGCGGTGGCGCCTTCAGCTGGGGCTCGCTGTGGAGCGGCATTAAA
AATTTCGGTTCCGCCGTTAAGAACTATGGCAGCAAAGCCTGGAACAGCAGCACAGGCCAGATGCTGAGGG
ACAAGTTGAAAGAGCAAAATTTCCAACAAAGGTGGTAGATGGCCTGGCCTCTGGCATTAGCGGGGTGGT
GGACCTGGCCAACCAGGCAGTGCAAAATAAGATTAACAGTAAGCTTGATCCCCGCCCTCCCGTAGAGGAG
CCTCCACCGGCCGTGGAGACAGTGTCTCCAGAGGGGCGTGGCGAAAAGCGTCCGCGACCCGACAGGGAAG
AAACTCTGGTGACGCAAATAGACGAGCCTCCCTCGTACGAGGAGGCACTAAAGCAAGGCCTGCCCACCAC
CGTCCCATCGCGCCCATGGCTACCGGAGTGCTGGGCCAGCACACACCCGTAACGCTGGACCTGCCTCCC
CCCGCCGACACCCAGCAGAAACCTGTGCTGCCAGGCCCGTCCGCCGTTGTTGTAACCCGTCCTAGCCGCG
GGTCCCTGCGCCGCGCCGCCAGCGGTCCGCGATCGTTGCGGCCCGTAGCCAGTGGCAACTGGCAAAGCAC
ACTGAACAGCATCGTGGGTCTGGGGGTGCAATCCCTGAAGCGCCGACGATGCTTCTGATCGCGGCCGCGA
TATCGCTAGCGAATTCGAAGTTCCTATTCTCTAGAAAGTATAGGAACTTCTCGAGCACGGGATCCTCTAG
AGTCGATAGCTAACGTGTCGTATGTGTGTCATGTATGCGTCCATGTCGCCGCCAGAGGAGCTGCTGAGCC
GCCGCGCGCCCGCTTTCCAAGATGGCTACCCCTTCGATGATGCCGCAGTGGTCTTACATGCACATCTCGG
GCCAGGACGCCTCGGAGTACCTGAGCCCCGGGCTGGTGCAGTTTGCCCGCGCCACCGAGACGTACTTCAG
CCTGAATAACAAGTTTAGAAACCCCACGGTGGCGCCTACGCACGACGTGACCACAGACCGGTCCCAGCGT
TTGACGCTGCGGTTCATCCCTGTGGACCGTGAGGATACTGCGTACTCGTACAAGGCGCGGTTCACCCTAG
CTGTGGGTGATAACCGTGTGCTGGACATGGCTTCCACGTACTTTGACATCCGCGGCGTGCTGGACAGGGG
CCCTACTTTTAAGCCCTACTCTGGCACTGCCTACAACGCCCTGGCTCCCAAGGGTGCCCCAAATCCTTGC
GAATGGACATATAAAGCCGATGGTGAAACTGCCACAGAAAAAACCCACGTATTTGGGCAGGCGCCTTATT
CTGGTATAAATATTACAAAAGATGGTATTCAACTTGGAACTGACACCGATGATCAGCCAATCTACGCAGA
TAAAACATTTCAACCTGAACCTCAAATAGGAGAATCTCAGTGGTACGAAACTGAAATTAATCATGCAGCT
GGGAGAGTCCTTAAAAAGACTACCCCAATGAAACCATGTTACGGTTCATATGCAAAACCCACAAATGAAA
ATGGAGGGCAAGCAAATGTGAAAACAGGAACAGGCACTACTAAAGAATATGACATAGACATGCAATTTTT
```

SEQ ID NO:39 (continued)

```
CGACAACAGAAGTGCGGCTGCTGCTGGCCTAGCTCCAGAAGTGGTATTGTACAGTGAAGATGTAGATATA
GAAACCCCAGACACTCATATTTCTTACATGCCCACTATTAAGGAAGGTAACTCACGAGAACTAATGGGCC
AACAATCTATGCCCAACAGGCCTAATTACATTGCTTTTAGGGACAATTTTATTGGTCTAATGTATTACAA
CAGCACGGGTAATATGGGTGTTCTGGCGGGCCAAGCATCGCAGTTGAATGCTGTTGTAGATTTGCAAGAC
AGAAACACAGAGCTTTCATACCAGCTTTTGCTTGATTCCATTGGTGATAGAACCAGGTACTTTTCTATGT
GGAATCAGGCTGTTGACAGCTATGATCCAGATGTTAGAATTATTGAAAATCATGGAACTGAAGATGAACT
TCCAAATTACTGCTTTCCACTGGGAGGTGTGATTAGAACAGATACTTATCAGGGAATTAAGGCTAATGGA
ACTGATCAAACCACATGGACCAAAGATGACAGTGTCAATGATGCTAATGAGGAAATAAGAGTTGGAAATA
ATTTTGCCATGGAAATCAATCTAAATGCCAACCTGTGGAGAAATTTCCTGTACTCCAACATAGCGCTGTA
TTTGCCCGACAAGCTAAAGTACAGTCCTTCCAACGTAAAAATTTCTGATAACCCAAACACCTACGACTAC
ATGAACAAGCGAGTGGTGGCTCCCGGGTTAGTGGACTGCTACATTAACCTTGGAGCACGCTGGTCCCTTG
ACTATATGGACAACGTCAACCCATTTAACCACCACCGCAATGCTGGCCTGCGCTACCGCTCAATGTTGCT
GGGCAATGGTCGCTATGTGCCCTTCCACATCCAGGTGCCTCAGAAGTTCTTTGCCATTAAAAACCTCCTT
CTCCTGCCGGGCTCATACACCTACGAGTGGAACTTCAGGAAGGATGTTAACATGGTTCTGCAGAGCTCTC
TGGGAAACGACCTTAGAGTTGACGGGGCTAGCATTAAGTTTGACAGCATTTGTCTTTACGCCACCTTCTT
CCCCATGGCCCACAACACGGCCTCCACGCTGGAAGCCATGCTCAGAAATGACACCAACGACCAGTCCTTT
AATGACTACCTTTCCGCCGCCAACATGCTATATCCCATACCCGCCAACGCCACCAACGTGCCCATCTCCA
TCCCATCGCGCAACTGGGCAGCATTTCGCGGTTGGGCCTTCACACGCTTGAAGACAAAGGAAACCCCTTC
CCTGGGATCAGGCTACGACCCTTACTACACCTACTCTGGCTCCATACCATACCTTGACGGAACCTTCTAT
CTTAATCACACCTTTAAGAAGGTGGCCATTACTTTTGACTCTTCTGTTAGCTGGCCGGGCAACGACCGCC
TGCTTACTCCCAATGAGTTTGAGATTAAGCGCTCAGTTGACGGGGAGGGCTATAACGTAGCTCAGTGCAA
CATGACAAAGGACTGGTTCCTAGTGCAGATGTTGGCCAACTACAATATTGGCTACCAGGGCTTCTACATT
CCAGAAAGCTACAAAGACCGCATGTACTCGTTCTTCAGAAACTTCCAGCCCATGAGCCGGCAAGTGGTGG
ACGATACTAAATACAAAGATTATCAGCAGGTTGGAATTATCCACCAGCATAACAACTCAGGCTTCGTAGG
CTACCTCGCTCCCACCATGCGCGAGGGACAAGCTTACCCCGCTAATGTTCCCTACCCACTAATAGGCAAA
ACCGCGGTTGATAGTATTACCCAGAAAAAGTTTCTTTGCGACCGCACCCTGTGGCGCATCCCCTTCTCCA
GTAACTTTATGTCCATGGGTGCGCTCACAGACCTGGGCCAAAACCTTCTCTACGCAAACTCCGCCCACGC
GCTAGACATGACCTTTGAGGTGGATCCCATGGACGAGCCCACCCTTCTTTATGTTTTGTTTGAAGTCTTT
GACGTGGTCCGTGTGCACCAGCCGCACCGCGGCGTCATCGAGACCGTGTACCTGCGCACGCCCTTCTCGG
CCGGCAACGCCACAACATAAAGAAGCAAGCAACATCAACAACAGCTGCCGCCATGGGCTCCAGTGAGCAG
GAACTGAAAGCCATTGTCAAAGATCTTGGTTGTGGGCCATATTTTTGGGCACCTATGACAAGCGCTTCC
CAGGCTTTGTTTCCCCACACAAGCTCGCCTGCGCCATAGTTAACACGGCCGGTCGCGAGACTGGGGCGT
ACACTGGATGGCCTTTGCCTGGAACCCGCGCTCAAAAACATGCTACCTCTTTGAGCCCTTTGGCTTTTCT
GACCAACGTCTCAAGCAGGTTTACCAGTTTGAGTACGAGTCACTCCTGCGCCGTAGCGCCATTGCCTCTT
CCCCCGACCGCTGTATAACGCTGGAAAAGTCCACCCAAAGCGTGCAGGGGCCCAACTCGGCCGCCTGTGG
CCTATTCTGCTGCATGTTTCTCCACGCCTTTGCCAACTGGCCCCAAACTCCCATGGATCACAACCCCACC
ATGAACCTTATTACCGGGGTACCCAACTCCATGCTTAACAGTCCCCAGGTACAGCCCACCCTGCGCCGCA
ACCAGGAACAGCTCTACAGCTTCCTGGAGCGCCACTCGCCCTACTTCCGCAGCCACAGTGCGCAAATTAG
GAGCGCCACTTCTTTTTGTCACTTGAAAAACATGTAAAAATAATGTACTAGGAGACACTTTCAATAAAGG
CAAATGTTTTTATTTGTACACTCTCGGGTGATTATTTACCCCCACCCTTGCCGTCTGCGCCGTTTAAAAA
TCAAAGGGGTTCTGCCGCGCATCGCTATGCGCCACTGGCAGGGACACGTTGCGATACTGGTGTTTAGTGC
TCCACTTAAACTCAGGCACAACCATCCGCGGCAGCTCGGTGAAGTTTTCACTCCACAGGCTGCGCACCAT
CACCAACGCGTTTAGCAGGTCGGGCGCCGATATCTTGAAGTCGCAGTTGGGGCCTCCGCCCTGCGCGCGC
GAGTTGCGATACACAGGGTTACAGCACTGGAACACTATCAGCGCCGGGTGGTGCACGCTGGCCAGCACGC
TCTTGTCGGAGATCANATCCGCGTCCAGGTCCTCCGCGTTGCTCAGGGCGAACGGAGTCAACTTTGGTAG
CTGCCTTCCCAAAAAGGGTGCATGCCCAGGCTTTGAGTTGCACTCGCACCGTAGTGGCATCAGAAGGTGA
CCGTGCCCAGTCTGGGCGTTAGGATACAGCGCCTGCATGAAAGCCTTGATCTGCTTAAAAGCCACCTGAG
CCTTTGCGCCTTCAGAGAAGAACATGCCGCAAGACTTGCCGGAAAACTGATTGGCCGGACAGGCCGCGTC
ATGCACGCAGCACCTTGCGTCGGTGTTGGAGATCTGCACCACATTTCGGCCCCACCGGTTCTTCACGATC
TTGGCCTTGCTAGACTGCTCCTTCAGCGCGCGCTGCCCGTTTTCGCTCGTCACATCCATTTCAATCACGT
GCTCCTTATTTATCATAATGCTCCCGTGTAGACACTTAAGCTCGCCTTCGATCTCAGCGCAGCGGTGCAG
CCACAACGCGCAGCCCGTGGGCTCGTGGTGCTTGTAGGTTACCTCTGCAAACGACTGCAGGTACGCCTGC
```

FIG. 64 (continued)

SEQ ID NO:39 (continued)

```
AGGAATCGCCCCATCATCGTCACAAAGGTCTTGTTGCTGGTGAAGGTCAGCTGCAACCCGCGGTGCTCCT
CGTTTAGCCAGGTCTTGCATACGGCCGCCAGAGCTTCCACTTGGTCAGGCAGTAGCTTGAAGTTTGCCTT
TAGATCGTTATCCACGTGGTACTTGTCCATCAACGCGCGCGCAGCCTCCATGCCCTTCTCCCACGCAGAC
ACGATCGGCAGGCTCAGCGGGTTTATCACCGTGCTTTCACTTTCCGCTTCACTGGACTCTTCCTTTTCCT
CTTGCATCCGCATACCCCGCGCCACTGGGTCGTCTTCATTCAGCCGCCGCACCGTGCGCTTACCTCCCTT
GCCGTGCTTGATTAGCACCGGTGGGTTGCTGAAACCCACCATTTGTAGCGCCACATCTTCTCTTTCTTCC
TCGCTGTCCACGATCACCTCTGGGGATGGCGGGCGCTCGGGCTTGGGAGAGGGGCGCTTCTTTTTCTTTT
TGGACGCAATGGCCAAATCCGCCGTCGAGGTCGATGGCCGCGGGCTGGGTGTGCGCGGCACCAGCGCATC
TTGTGACGAGTCTTCTTCGTCCTCGGACTCGAGACGCCGCCTCAGCCGCTTTTTTGGGGCGCGCGGGGA
GGCGGCGGCGACGGCGACGGGGACGAGACGTCCTCCATGGTTGGTGGACGTCGCGCCGCACCGCGTCCGC
GCTCGGGGGTGGTTTCGCGCTGCTCCTCTTCCCGACTGGCCATTTCCTTCTCCTATAGGCAGAAAAAGAT
CATGGAGTCAGTCGAGAAGGAGGACAGCCTAACCGCCCCCTTTGAGTTCGCCACCACCGCCTCCACCGAT
GCCGCCAACGCGCCTACCACCTTCCCCGTCGAGGCACCCCGCTTGAGGAGGAGGAAGTGATTATCGAGC
AGGACCCAGGTTTTGTAAGCGAAGACGACGAAGATCGCTCAGTACCAACAGAGGATAAAAAGCAAGACCA
GGACGACGCAGAGGCAAACGAGGAACAAGTCGGGCGGGGGGACCAAAGGCATGGCGACTACCTAGATGTG
GGAGACGACGTGCTGTTGAAGCATCTGCAGCGCCAGTGCGCCATTATCTGCGACGCGTTGCAAGAGCGCA
GCGATGTGCCCCTCGCCATAGCGGATGTCAGCCTTGCCTACGAACGCCACCTGTTCTCACCGCGCGTACC
CCCCAAACGCCAAGAAAACGGCACATGCGAGCCCAACCCGCGCCTCAACTTCTACCCGTATTTGCCGTG
CCAGAGGTGCTTGCCACCTATCACATCTTTTTCCAAAACTGCAAGATACCCCTATCCTGCCGTGCCAACC
GCAGCCGAGCGGACAAGCAGCTGGCCTTGCGGCAGGGCGCTGTCATACCTGATATCGCCTCGCTCGACGA
AGTGCCAAAAATCTTTGAGGGTCTTGGACGCGACGAGAAGCGCGCGGCAAACGCTCTGCAACAAGAAAAC
AGCGAAAATGAAAGTCACTGTGGAGTGCTGGTGGAACTTGAGGGTGACAACGCGCGCCTAGCCGTGCTGA
AACGCAGCATCGAGGTCACCCACTTTGCCTACCCGGCACTTAACCTACCCCCCAAGGTTATGAGCACAGT
CATGAGCGAGCTGATCGTGCGCCGTGCACGACCCTGGAGAGGGATGCAAACTTGCAAGAACAAACCGAG
GAGGGCCTACCCGCAGTTGGCGATGAGCAGCTGGCGCGCTGGCTTGAGACGCGCGAGCCTGCCGACTTGG
AGGAGCGACGCAAGCTAATGATGGCCGCAGTGCTTGTTACCGTGGAGCTTGAGTGCATGCAGCGGTTCTT
TGCTGACCCGGAGATGCAGCGCAAGCTAGAGGAAACGTTGCACTACACCTTTCGCCAGGGCTACGTGCGC
CAGGCCTGCAAAATTTCCAACGTGGAGCTCTGCAACCTGGTCTCCTACCTTGGAATTTTGCACGAAAACC
GCCTTGGGCAAAACGTGCTTCATTCCACGCTCAAGGGCGAGGCGCGCCGCGACTACGTCCGCGACTGCGT
TTACTTATTTCTGTGCTACACCTGGCAAACGGCCATGGGCGTGTGGCAGCAGTGCCTGGAGGAGCGCAAC
CTGAAGGAGCTGCAGAAGCTGCTAAAGCAAAACTTGAAGGACCTATGGACGGCCTTCAACGAGCGCTCCG
TGGCCGCGCACCTGGCGGACATTATCTTCCCCGAACGCCTGCTTAAAACCCTGCAACAGGGTCTGCCAGA
CTTCACCAGTCAAAGCATGTTGCAAAACTTTAGGAACTTTATCCTAGAGCGTTCAGGAATTCTGCCCGCC
ACCTGCTGTGCGCTTCCTAGCGACTTTGTGCCCATTAAGTACCGTGAATGCCCTCCGCCGCTTTGGGGTC
ACTGCTACCTTNTGCAGCTAGCCAACTACCTTGCCTACCACTCCGACATCATGGAAGACGTGAGCGGTGA
CGGCCTACTGGAGTGTCACTGTCGCTGCAACCTATGCACCCCGCACCGCTCCTGGTCTGCAATTCACAA
CTGCTTAGCGAAAGTCAAATTATCGGTACCTTTGAGCTGCAGGGTCCCTCGCCTGACGAAAAGTCCGCGG
CTCCGGGGTTGAAACTCACTCCGGGGCTGTGGACGTCGGCTTACCTTCGCAAATTTGTACCTGAGGACTA
CCACGCCCACGAGATTAGGTTCTACGAAGACCAATCCCGCCCGCCAAATGCGGAGCTTACCGCCTGCGTC
ATTACCCAGGGCCACATCCTTGGCCAATTGCAAGCCATTAACAAAGCCCGCCAAGAGTTTCTGCTACGAA
AGGGACGGGGGGTTTACTTGGACCCCCAGTCCGGCGAGGAGCTCAACCCAATCCCCCCGCCGCCGCAGCC
CTATCAGCAGCCGCGGGCCCTTGCTTCCAGGATGGCACCCAAAAAGAAGCTGCAGCTGCCGCCGCCGCC
ACCCACGGACGAGGAGGAATACTGGGACAGTCAGGCAGAGGAGGTTTTGGACGAGGAGGAGGAGATGATG
GAAGACTGGGACAGCCTAGACGAGGAAGCTTCCGAGGCCGAAGAGGTGTCAGACGAAACACCGTCACCCT
CGGTCGCATTCCCCTCGCCGGCGCCCCAGAAATCGGCAACCGTTCCCAGCATTGCTACAACCTCCGCTCC
TCAGGCGCCGCCGGCACTGCCCGTTCGCCGACCCAACCGTAGATGGGACACCACTGGAACCAGGGCCGGT
AAGTCTAAGCAGCCGCCGCCGTTAGCCCAAGAGCAACAACAGCGCCAAGGCTACCGCTCGTGGCGCGTGC
ACAAGAACGCCATAGTTGCTTGCTTGCAAGACTGTGGGGCAACATCTCCTTCGCCCGCCGCTTTCTTCT
CTACCATCACGGCGTGGCCTTCCCCCGTAACATCCTGCATTACTACCGTCATCTCTACAGCCCCTACTGC
ACCGGCGGCAGCGGCAGCAACAGCAGCGGCCACGCAGAAGCAAAGGCGACCGGATAGCAAGACTCTGACA
AAGCCCAAGAAATCCACAGCGGCGGCAGCAGCAGGAGGAGGAGCACTGCGTCTGGCGCCCAACGAACCCG
TATCGACCCGCGAGCTTAGAAACAGGATTTTTCCCACTCTGTATGCTATATTTCAACAGAGCAGGGGCCA
```

SEQ ID NO:39 (continued)

```
AGAACAAGAGCTGAAAATAAAAAACAGGTCTCTGCGCTCCCTCACCCGCAGCTGCCTGTATCACAAAAGC
GAAGATCAGCTTCGGCGCACGCTGGAAGACGCGGAGGCTCTCTTCAGCAAATACTGCGCGCTGACTCTTA
AGGACTAGTTTCGCGCCCTTTCTCAAATTTAAGCGCGAAAACTACGTCATCTCCAGCGGCCACACCCGGC
GCCAGCACCTGTCGTCAGCGCCATTATGAGCAAGGAAATTCCCACGCCCTACATGTGGAGTTACCAGCCA
CAAATGGACTTGCGGCTGGAGCTGCCCAAGACTACTCAACCCGAATAAACTACATGAGCGCGGGACCCC
ACATGATATCCCGGGTCAACGGAATCCGCGCCCACCGAAACCGAATTCTCCTCGAACAGGCGGCTATTAC
CACCACACCTCGTAATAACCTTAATCCCCGTAGTTGGCCCGCTGCCCTGGTGTACCAGGAAAGTCCCGCT
CCCACCACTGTGGTACTTCCCAGAGACGCCCAGGCCGAAGTTCAGATGACTAACTCAGGGGCGCAGCTTG
CGGGCGGCTTTCGTCACAGGGTGCGGTCGCCCGGGCAGGGTATAACTCACCTGAAAATCAGAGGGCGAGG
TATTCAGCTCAACGACGAGTCGGTGAGCTCCTCTCTTGGTCTCCGTCCGGACGGGACATTTCAGATCGGC
GGCGCTGGCCGCTCTTCATTTACGCCCGTCAGGCGATCCTAACTCTGCAGACCTCGTCCTCGGAGCCGC
GCTCCGGAGGCATTGGAACTCTACAATTTATTGAGGAGTTCGTGCCTTCGGTTTACTTCAACCCCTTTTC
TGGACCTCCCGGCCACTACCCGGACCAGTTTATTCCCAACTTTGACGCGGTAAAAGACTCGGCGGACGGC
TACGACTGACAGATCTGAGCTCGCGGCCGCGATATCGCTAGCGAAGTTCCTATTCTCTAGAAAGTATAGG
AACTTCGATCCTCTAGAGTCGACCTGCAGGCATGCAAGCTTGGCACTGCAATAAATTACTTACTTAAAAT
CAGTCAGCAAATCTTTGTCCAGCTTATTCAGCATCACCTCCTTTCCCTCCTCCCAACTCTGGTATTTCAG
CAGCCTTTTAGCTGCGAACTTTCTCCAAAGTCTAAATGGGATGTCAAATTCCTCATGTTCTTGTCCCTCC
GCACCCACTATCTTCATATTGTTGCAGATGAAACGCGCCAGACCGTCTGAAGACACCTTCAACCCTGTGT
ACCCATATGACACGGAAACCGGCCCTCCAACTGTGCCTTTCCTTACCCCTCCCTTTGTGTCGCCAAATGG
GTTCCAAGAAAGTCCCCCCGGAGTGCTTTCTTTGCGTCTTTCAGAACCTTTGGTTACCTCACACGGCATG
CTTGCGCTAAAAATGGGCAGCGGCCTGTCCCTGGATCAGGCAGGCAACCTTACATCAAATACAATCACTG
TTTCTCAACCGCTAAAAAAACAAAGTCCAATATAACTTTGGAAACATCCGCGCCCTTACAGTCAGCTC
AGGCGCCCTAACCATGGCCACAACTTCGCCTTTGGTGGTCTCTGACAACACTCTTACCATGCAATCACAA
GCACCGCTAACCGTGCAAGACTCAAAACTTAGCATTGCTACCAAAGAGCCACTTACAGTGTTAGATGGAA
AACTGGCCCTGCAGACATCAGCCCCCTCTCTGCCACTGATAACAACGCCCTCACTATCACTGCCTCACC
TCCTCTTACTACTGCAAATGGTAGTCTGGCTGTTACCATGGAAAACCCACTTTACAACAACAATGGAAAA
CTTGGGCTCAAAATTGGCGGTCCTTTGCAAGTGGCCACCGACTCACATGCACTAACACTAGGTACTGGTC
AGGGGGTTGCAGTTCATAACAATTTGCTACATACAAAAGTTACAGGCGCAATAGGGTTTGATACATCTGG
CAACATGGAACTTAAAACTGGAGATGGCCTCTATGTGGATAGCGCCGGTCCTAACCAAAAACTACATATT
AATCTAAATACCACAAAAGGCCTTGCTTTTGACAACACCGCAATAACAATTAACGCTGGAAAAGGGTTGG
AATTTGAAACAGACTCCTCAAACGGAAATCCCATAAAAACAAAAATTGGATCAGGCATACAATATAATAC
CAATGGAGCTATGGTTGCAAAACTTGGAACAGGCCTCAGTTTTGACAGCTCCGGAGCCATAACAATGGGC
AGCATAAACAATGACAGACTTACTCTTTGGACAACACCAGACCCATCCCCAAATTGCAGAATTGCTTCAG
ATAAAGACTGCAAGCTAACTCTGGCGCTAACAAAATGTGGCAGTCAAATTTTGGGCACTGTTTCAGCTTT
GGCAGTATCAGGTAATATGGCCTCCATCAATGGAACTCTAAGCAGTGTAAACTTGGTTCTTAGATTTGAT
GACAACGGAGTGCTTATGTCAAATTCATCACTGGACAAACAGTATTGGAACTTTAGAAACGGGGACTCCA
CTAACGGTCAACCATACACTTATGCTGTTGGGTTTATGCCAAACCTAAAAGCTTACCCAAAAACTCAAAG
TAAAACTGCAAAAGTAATATTGTTAGCCAGGTGTATCTTAATGGTGACAAGTCTAAACCATTGCATTTT
ACTATTACGCTAAATGGAACAGATGAAACCAACCAAGTAAGCAAATACTCAATATCATTCAGTTGGTCCT
GGAACAGTGGACAATACACTAATGACAAATTTGCCACCAATTCCTATACCTTCTCCTACATTGCCCAGGA
ATAAAGAATCGTGAACCTGTTGCATGTTATGTTTCAACGTGTTTATTTTTCAATTCGTATTAGTCATCGC
TATTACCATGGTGATGCGGTTTTGGCAGTACATCAATGGGCGTGGATAGCGGTTTGACTCACGGGGATTT
CCAAGTCTCCACCCCATTGACGTCAATGGGAGTTTGTTTTGGCACCAAAATCAACGGGACTTTCCAAAAT
GTCGTAACAACTCCGCCCCATTGACGCAAATGGGCGGTAGGCGTGTACGGTGGGAGGTCTATATAAGCAG
AGCTGGTTTAGTGAACCGTCAGATCCGCTAGAGATCCACCATGTTTGTCTTTCTCGTGCTGCTGCCCCTC
GTGAGCAGCCAGTGCGTCAATCTGACAACAAGGACCCAGCTGCCCCCGCCTACACCAACTCCTTCACAA
GAGGCGTGTATTACCCCGATAAGGTCTTCAGATCCAGCGTCCTCCACAGCACCCAAGATTTGTTTCTGCC
TTTCTTCAGCAACGTGACATGGTTCCACGCCATTCATGTCAGCGGCACAAACGGCACAAGAGGTTTGAC
AACCCCGTGCTCCCCTTCAACGACGGCGTGTACTTCGCCAGCACAGAGAAATCCAATATCATTAGGGGCT
GGATCTTCGGCACAACACTGGATTCCAAGACCCAGTCTCTGCTCATTGTGAATAACGCCACCAACGTGGT
GATTAAGGTCTGTGAGTTTCAGTTCTGCAACGACCCCTTTCTGGGAGTCTACTACCACAAGAATAATAAG
AGCTGGATGGAGTCCGAGTTTAGGGTGTACAGCTCCGCCAACAACTGTACCTTCGAATACGTGTCCCAGC
```

SEQ ID NO:39 (continued)

```
CTTTCCTCATGGATCTGGAGGGCAAGCAAGGCAATTTCAAAAATCTGAGAGAGTTCGTGTTCAAAAACAT
TGATGGATACTTCAAAATCTACAGCAAGCATACCCCCATTAATCTGGTGAGGGATCTGCCCCAAGGATTC
TCCGCTCTGGAACCTCTGGTGGATCTGCCCATTGGCATTAACATCACAAGATTCCAGACCCTCCTCGCCC
TCCATAGATCCTATCTGACCCCCGGCGACTCCTCCAGCGGATGGACAGCCGGAGCTGCCGCCTACTACGT
GGGCTATCTGCAGCCAAGAACCTTTCTGCTGAAGTACAACGAGAACGGCACCATCACAGACGCTGTCGAT
TGCGCTCTCGACCCTCTGAGCGAGACCAAATGCACACTGAAGAGCTTCACCGTGGAAAAGGGCATCTATC
AGACCAGCAACTTCAGAGTGCAGCCTACCGAGAGCATTGTGAGGTTTCCCAACATCACCAATCTGTGTCC
TTTCGGCGAGGTCTTTAATGCCACAAGGTTCGCTTCCGTGTATGCTTGGAATAGGAAGAGGATCAGCAAT
TGCGTCGCCGACTATTCCGTCCTCTATAACAGCGCCTCCTTCTCCACCTTCAAATGTTATGGCGTGTCCC
CCACCAAGCTCAACGACCTCTGCTTCACCAATGTGTACGCTGACTCCTTCGTCATTAGGGGCGACGAGGT
GAGGCAAATTGCCCCCGGCCAGACCGGCAAGATTGCTGATTACAACTACAAACTGCCCGACGATTTTACC
GGCTGCGTGATCGCTTGGAACTCCAACAATCTGGACTCCAAAGTGGGCGGAAACTACAATTACCTCTACA
GACTCTTTAGAAAAAGCAATCTGAAGCCCTTCGAGAGAGACATCTCCACCGAAATCTACCAAGCCGGAAG
CACACCTTGCAATGGCGTCGAGGGATTTAACTGCTACTTCCCTCTGCAGAGCTACGGCTTTCAACCTACC
AACGGCGTCGGATATCAACCCTATAGGGTGGTCGTGCTGAGCTTTGAACTGCTGCATGCTCCCGCCACCG
TCTGCGGACCTAAGAAGAGCACCAATCTCGTCAAAACAAGTGCGTGAACTTCAACTTCAATGGACTGAC
CGGCACCGGCGTGCTGACCGAGAGCAATAAGAAGTTTCTGCCCTTCCAGCAGTTCGGAAGGGATATTGCC
GATACCACAGATGCTGTGAGGGACCCCCAAACCCTCGAGATTCTGGATATCACCCCTTGCAGCTTCGGAG
GAGTGTCCGTGATCACCCCCGGAACAAACACCTCCAATCAAGTGGCTGTGCTGTACCAAGACGTGAACTG
CACAGAAGTCCCCGTGGCCATCCATGCCGACCAGCTGACCCCTACATGGAGAGTGTACTCCACCGGCAGC
AATGTGTTCCAGACAAGAGCCGGATGCCTCATTGGAGCTGAACACGTCAACAACAGCTACGAGTGCGACA
TTCCCATCGGCGCCGGCATTTGTGCCTCCTATCAGACCCAGACCAACAGCCCAAGAAGGGCTAGAAGCGT
CGCTTCCCAATCCATCATTGCCTACACCATGTCTCTGGGAGCCGAAAACTCCGTCGCCTACTCCAACAAT
AGCATCGCCATCCCCACCAATTTTACCATCTCCGTGACCACAGAGATTCTGCCCGTGTCCATGACAAAGA
CATCCGTGGACTGCACCATGTACATCTGTGGCGACAGCACCGAGTGTAGCAATCTGCTGCTGCAATATGG
CAGCTTCTGCACCCAGCTGAACAGAGCCCTCACCGGCATCGCCGTCGAACAAGACAAGAACACCCAAGAG
GTGTTCGCCCAAGTGAAGCAAATCTACAAGACCCCCCCTATCAAAGATTTCGGAGGATTCAACTTTAGCC
AGATTCTGCCCGATCCTAGCAAGCCTTCCAAGAGGAGCTTCATCGAGGATCTGCTGTTTAATAAGGTGAC
ACTGGCCGACGCTGGCTTCATTAAACAGTACGGCGATTGTCTGGGCGACATCGCTGCTAGGGATCTGATC
TGCGCTCAGAAGTTCAACGGACTGACAGTCCTCCCTCCTCTGCTGACCGACGAGATGATCGCTCAGTATA
CCAGCGCTCTGCTGGCTGGAACCATTACCAGCGGCTGGACATTCGGCGCTGGAGCCGCCCTCCAAATTCC
CTTTGCCATGCAGATGGCCTATAGATTCAACGGCATTGGCGTCACCCAAAATGTGCTGTATGAAAATCAG
AAGCTGATTGCTAACCAATTCAATAGCGCCATTGGCAAGATCCAAGACTCTCTGAGCTCCACAGCCAGCG
CCCTCGGAAAGCTGCAAGACGTGGTGAATCAAAACGCCCAAGCTCTGAACACACTGGTGAAACAGCTCAG
CAGCAACTTTGGAGCCATCAGCAGCGTGCTCAATGATATCCTCTCTAGGCTGGACCCTCCGGAGGCCGAA
GTCCAGATCGATAGACTCATCACCGGCAGACTCCAATCTCTGCAGACATACGTCACCCAACAGCTCATTA
GAGCTGCCGAAATCAGAGCCTCCGCCAATCTGGCCGCCACCAAGATGTCCGAGTGCGTGCTGGGACAGAG
CAAGAGAGTGGACTTCTGTGGCAAGGGATACCATCTGATGAGCTTCCCCCAGAGCGCTCCCCATGGAGTG
GTCTTTCTGCATGTCACATACGTGCCCGCCCAAGAGAAGAACTTCACCACCGCTCCCGCCATTTGCCACG
ATGGAAAGGCCCACTTTCCCAGAGAAGGAGTGTTCGTGAGCAACGGCACACACTGGTTTGTCACCCAGAG
AAATTTTTACGAGCCCCAGATTATCACCACCGACAACACCTTCGTGTCCGGAAACTGCGATGTCGTGATT
GGCATCGTGAACAACACAGTCTACGACCCTCTGCAGCCCGAACTCGACAGCTTCAAGGAAGAGCTGGACA
AGTACTTCAAGAATCACACATCCCCCGACGTGGATCTGGGCGACATTAGCGGCATTAATGCCTCCGTCGT
CAACATTCAGAAGGAGATTGATAGACTGAATGAAGTCGCCAAGAACCTCAATGAGTCTCTGATTGATCTG
CAAGAGCTGGGCAAGTACGAGCAATACATCAAATGGCCTTGGTACATCTGGCTGGGATTCATCGCTGGAC
TCATCGCCATCGTGATGGTCACCATTATGCTGTGTTGCATGACCAGCTGCTGCAGCTGTCTGAAGGGCTG
CTGCAGCTGCGGAAGCTGCTGCAAGTTTGACGAAGACGACTCCGAGCCCGTGCTGAAGGGCGTCAAGCTG
CATTATACATAAACTAGTGCTGGAATTCGCCCTTATAGAGTGCTGGAATTCGCCCTTATAGAGTGCTGGA
ATTCGCCCTTATATCTAGTAACGGCCGCCAGTGTGCTGGAATTCGCCCTTATAACTTCGTATAGCATACA
TTATACGAAGTTATAAGGGCGAATTCTGCAGATATCCATCCTTTAAAAAACCTCCCACACCTCCCCCTGA
ACCTGAAACATAAAATGAATGCAATTGTTGTTGTTAACTTGTTTATTGCAGCTTATAATGGTTACAAATA
AAGCAATAGCATCACAAATTTCACAAATAAAGCATTTTTTCACTGCATTCTAGTTGTGGTTTGTCCAAA
```

FIG. 64 (continued)

SEQ ID NO:39 (continued)

```
CTCATCAATGTATCTTAACAACGTGTTTATTTTTCAATTGCAGAAAGAATTGCAGAAAATTTCAAGTCAT
TTTTCATTCAGTAGTATAGCCCCACCACCACATAGCTTATACTAATCACCGTACCTTAATCAAACTCACA
GAACCCTAGTATTCAACCTGCCACCTCCCTCCCAACACACAGAGTACACAGTCCTTTCTCCCGGCTGGC
CTTAAACAGCATCATATCATGGGTAACAGACATATTCTTAGGTGTTATATTCCACACGGTCTCCTGTCGA
GCCAAACGCTCATCAGTGATGTTAATAAACTCCCCGGGCAGCTCGCTTAAGTTCATGTCGCTGTCCAGCT
GCTGAGCCACAGGCTGCTGTCCAACTTGCGGTTGCTCAACGGGCGGCGAAGGAGAAGTCCACGCCTACAT
GGGGGTAGAGTCATAATCGTGCATCAGGATAGGGCGGTGGTGCTGCAGCAGCGCGCGAATAAACTGCTGC
CGCCGCCGCTCCGTCCTGCAGGAATACAACATGGCAGTGGTCTCCTCAGCGATGATTCGCACCGCCCGCA
GCATAAGGCGCCTTGTCCTCCGGGCACAGCAGCGCACCCTGATCTCACTTAAGTCAGCACAGTAACTGCA
GCACAGTACCACAATATTGTTTAAAATCCCACAGTGCAAGGCGCTGTATCCAAAGCTCATGGCGGGGACC
ACAGAACCCACGTGGCCATCATACCACAAGCGCAGGTAGATTAAGTGGCGACCCCTCATAAACACGCTGG
ACATAAACATTACCTCTTTTGGCATGTTGTAATTCACCACCTCCCGGTACCATATAAACCTCTGATTAAA
CATGGCGCCATCCACCACCATCCTAAACCAGCTGGCCAAAACCTGCCCGCCGGCTATGCACTGCAGGGAA
CCGGGACTGGAACAATGACAGTGGAGAGCCCAGGACTCGTAACCATGGATCATCATGCTCGTCATGATAT
CAATGTTGGCACAACACAGGCACACGTGCATACACTTCCTCAGGATTACAAGCTCCTCCCGCGTCAGAAC
CATATCCCAGGGAACAACCCATTCCTGAATCAGCGTAAATCCCACACTGCAGGGAAGACCTCGCACGTAA
CTCACGTTGTGCATTGTCAAAGTGTTACATTCGGGCAGCAGCGGATGATCCTCCAGTATGGTAGCGCGTG
TCTCTGTCTCAAAAGGAGGTAGGCGATCCCTACTGTACGGAGTGCGCCGAGACAACCGAGATCGTGTTGG
TCGTAGTGTCATGCCAAATGGAACGCCGGACGTAGTCATATTTCCTGAAGCAAAACCAGGTGCGGGCGTG
ACAAACAGATCTGCGTCTCCGGTCTCGTCGCTTAGCTCGCTCTGTGTAGTAGTTGTAGTATATCCACTCT
CTCAAAGCATCCAGGCGCCCCCTGGCTTCGGGTTCTATGTAAACTCCTTCATGCGCCGCTGCCCTGATAA
CATCCACCACCGCAGAATAAGCCACACCCAGCCAACCTACACATTCGTTCTGCGAGTCACACACGGGAGG
AGCGGGAAGAGCTGGAAGAACCATGTTTTTTTTTTTATTCCAAAAGATTATCCAAAACCTCAAAATGAA
GATCTATTAAGTGAACGCGCTCCCCTCCGGTGGCGTGGTCAAACTCTACAGCCAAAGAACAGATAATGGC
ATTTGTAAGATGTTGCACAATGGCTTCCAAAAGGCAAACTGCCCTCACGTCCAAGTGGACGTAAAGGCTA
AACCCTTCANGGTGAATCTCCTCTATAAACATTCCAGCACCTTCAACCATGCCCAAATAATTTTCATCTC
GCCACCTTATCAATATGTCTCTAAGCAAATCCCGAATATTAAGTCCGGCCATTGTAAAAATCTGCTCCAG
AGCGCCCTCCACCTTCAGCCTCAAGCAGCGAATCATGATTGCAAAAATTCAGGTTCCTCACAGACCTGTA
TAAGATTCAAAAGCGGAACATTAACAAAAATACCGCGATCCCGTAGGTCCCTTCGCAGGGCCAGCTGAAC
ATAATCGTGCAGGTCTGCACGGACCAGCGCGGCCACTTCCCCGCCAGGAACCATGACAAAAGAACCCACA
CTGATTATGACACGCATACTCGGAGCTATGCTAACCAGCGTAGCCCCGATGTAAGCTTGTTGCATGGGCG
GCGATATAAAATGCAAGGTACTGCTCAAAAAATCAGGCAAAGCCTCGCGCAAAAAGCAAGCACATCGTA
GTCATGCTCATGCAGATAAAGGCAGGTAAGTTCCGGAACCACCACAGAAAAGACACCATTTTCTCTCA
AACATGTCTGCGGGTTCCTGCATAAACACAAATAAAATAACAAAAAAAAAAAAACATTTAAACATTAGA
AGCCTGTCTTACAACAGGAAAAACAACCCTTATAAGCATAAGACGGACTACGGCCATGCCGGCGTGACCG
TAAAAAAACTGGTCACCGTGATTAAAAAGCACCACCGACAGTTCCTCGGTCATGTCCGGAGTCATAATGT
AAGACTCGGTAAACACATCAGGTTGGTTAACATCGGTCAGTGCTAAAAAGCGACCGAAATAGCCCGGGGG
AATACATACCCGCAGGCGTAGAGACAACATTACAGCCCCATAGGAGGTATAACAAAATTAATAGGAGAG
AAAACACATAAACCCTGAAAAACCCTCCTGCCCCTAGGCAAATAGCACCCTCCCGCTCCAGAACAAC
ATACAGCGCTTCCACAGCGGCAGCCATAACAGTCAGCCTTACCAGTAAAAAACCTATTAAAAACACCA
CTCGACACGGCACCAGCTCAATCAGTCACAGTGTAAAAGGGCCAAGTACAGAGCGAGTATATATAGGAC
TAAAAAATGACGTAACGGTTAAAGTCCACAAAACCACCCAGAAACCGCACGCGAACCTACGCCCAGAA
ACGAAAGCCAAAAAACCCACAACTTCCTCAAATCTTCACTTCCGTTTTCCCACGATACGTCACTTCCCAT
TTTAAAAAAAAACTACAATTCCCAATACATGCAAGTTACTCCGCCCTAAAACCTACGTCACCCGCCCCGT
TCCCACGCCCCGCGCCACGTCACAAACTCCACCCCCTCATTATCATATTGGCTTCAATCCAAAATAAGGT
ATATTATTGATGATGGCGAT
```

FIG. 64 (continued)

ADENOVIRUS VECTORS AND METHODS FOR USING ADENOVIRUS VECTORS

CROSS-REFERENCE TO RELATED APPLICATIONS

This application claims the benefit of U.S. Patent Application Ser. No. 63/066,740, filed on Aug. 17, 2020. The disclosure of the prior application is considered part of (and is incorporated by reference in) the disclosure of this application.

SEQUENCE LISTING

The instant application contains a Sequence Listing which has been submitted electronically in ASCII format and is hereby incorporated by reference in its entirety. Said ASCII copy, created on Dec. 8, 2020, is named 07039_1964001_ST25.txt and is 822 KB in size.

TECHNICAL FIELD

This document relates to adenovirus vectors and methods and materials related to using adenovirus vectors. For example, adenovirus vectors can be used to deliver one or more immunogens (e.g., one or more immunogens associated with a pathogen causing an infection) to cells within a mammal such that the mammal produces an effective immune response against the immunogen(s).

BACKGROUND INFORMATION

An infectious disease caused by a coronavirus known as COVID-19 was first reported to the World Health Organization (WHO) Country Office in China on Dec. 31, 2019. As of Jun. 3, 2020, approximately 6,287,771 confirmed cases of COVID-19, including 379,941 deaths, have been reported to the WHO (covid19.who.int/).

SUMMARY

This document relates to adenovirus vectors and methods and materials related to using adenovirus vectors. For example, this document provides adenovirus vectors, nucleic acid molecules encoding adenovirus vectors, cell lines containing adenovirus vectors, and methods for using adenovirus vectors to deliver nucleic acid to cells in vitro or in vivo. This document also provides methods and materials for using adenovirus vectors to induce immune responses within a mammal (e.g., a human). In some cases, adenovirus vectors (e.g., single-cycle adenovirus (SC-Ad) vectors) can be used to deliver one or more (e.g., one, two, three, four, five, six, seven, eight, nine, ten, or more) immunogens that trigger an immune response within a mammal (e.g., a human).

As demonstrated herein, SC-Ads can be engineered to express one or more immunogens as fused and secreted polypeptides that can induce an effective immune response against those immunogens. For example, administration of SC-Ads expressing *C. difficile* TcdA/B fusion polypeptides protected mice and Syrian Hamsters from lethal toxin challenge for extended periods (e.g., over 36 weeks) after a single immunization.

Having the ability to produce immune responses effectively against viral and/or bacterial pathogens (e.g., a coronavirus) in mammals (e.g., humans) can improve survival and minimize the impact of the infection. Adenovirus vectors encoding one or more immunogens can be used to provide a mammal with sustained, long-term immunity against an infectious pathogen (e.g., a coronavirus). For example, adenovirus vectors encoding one or more immunogens associated with COVID-19 (e.g., one or more immunogens derived from SARS-CoV-2) can be used as a robust vaccine in the COVID-19 pandemic to generate humoral immunity against both primary infections and recurrences.

In general, one aspect of this document features a SC-Ad, where the SC-Ad has a genome lacking at least a portion of a nucleic acid sequence that encodes an adenovirus polypeptide, where the SC-Ad includes the adenovirus polypeptide, and where the SC-Ad includes a nucleic acid sequence encoding a coronavirus immunogen. The adenovirus polypeptide can be a fiber polypeptide, a V polypeptide, a hexon polypeptide, a penton base polypeptide, or a pIIIa polypeptide. The coronavirus immunogen can include a coronavirus Spike polypeptide or an immunogenic fragment thereof. The coronavirus immunogen can consist of or can consist essentially of an amino acid sequence set forth in any one of SEQ ID NOs:1-4. The SC-Ad also can include a nucleic acid sequence encoding an adjuvant polypeptide. The adjuvant polypeptide can be a granulocyte-macrophage colony-stimulating factor (GM-CSF) polypeptide, an interleukin 4 (IL-4) polypeptide, an interleukin 21 (IL-21) polypeptide, a CD40 ligand (CD40L) polypeptide, a 4-1BB ligand (4-1BBL) polypeptide, a transforming growth factor beta (TGF-β) polypeptide, a *Clostridium difficile* TcdA polypeptide, a *C. difficile* TcdB polypeptide, or a biologically active fragment thereof. The coronavirus Spike polypeptide can be fused to the adjuvant polypeptide. The coronavirus Spike polypeptide fused to the adjuvant polypeptide can consist essentially of or can consist of an amino acid sequence set forth in SEQ ID NO:5. The SC-Ad also can include a nucleic acid sequence encoding a chaff polypeptide. The chaff polypeptide can be a fragment of an ACE2 polypeptide. The fragment of an ACE2 polypeptide can include the extracellular region of an ACE2 polypeptide and can lack a transmembrane domain. The chaff polypeptide can consist essentially of or can consist of an amino acid sequence set forth in SEQ ID NO:8 or SEQ ID NO:9. The coronavirus Spike polypeptide can be fused to the chaff polypeptide.

In another aspect, this document features a composition including a SC-Ad, where the SC-Ad has a genome lacking at least a portion of a nucleic acid sequence that encodes an adenovirus polypeptide, where the SC-Ad includes the adenovirus polypeptide, and where the SC-Ad includes a nucleic acid sequence encoding a coronavirus immunogen.

In another aspect, this document features methods for inducing an immune response against a coronavirus in a mammal. The methods can include, or consist essentially of, administering to a mammal i) a SC-Ad, where the SC-Ad has a genome lacking at least a portion of a nucleic acid sequence that encodes an adenovirus polypeptide, where the SC-Ad includes the adenovirus polypeptide, and where the SC-Ad includes a nucleic acid sequence encoding a coronavirus immunogen; or ii) a composition including a SC-Ad, where the SC-Ad has a genome lacking at least a portion of a nucleic acid sequence that encodes an adenovirus polypeptide, where the SC-Ad includes the adenovirus polypeptide, and where the SC-Ad includes a nucleic acid sequence encoding a coronavirus immunogen, under conditions where the SC-Ad infects a cell of the mammal, and where expression of the immunogen in the cell leads to induction of the immune response. The mammal can be a human. The coronavirus can be a betacoronavirus. The betacoronavirus can be SARS-CoV-2. The administering can include mucosal delivery of the SC-Ad.

In another aspect, this document features a SC-Ad, where the SC-Ad has a genome lacking at least a portion of a nucleic acid sequence that encodes an adenovirus polypeptide, where the SC-Ad includes the adenovirus polypeptide, and where the SC-Ad includes (a) a nucleic acid sequence encoding an immunogen and (b) a nucleic acid sequence encoding an adjuvant polypeptide. The adenovirus polypeptide can be a fiber polypeptide, a V polypeptide, a hexon polypeptide, a penton base polypeptide, or a pIIIa polypeptide. The immunogen can be a coronavirus immunogen. The coronavirus immunogen can include a coronavirus Spike polypeptide or an immunogenic fragment thereof. The coronavirus immunogen can consist of or can consist essentially of an amino acid sequence set forth in any one of SEQ ID NOs:1-4. The adjuvant polypeptide can be a GM-CSF polypeptide, an IL-4 polypeptide, an IL-21 polypeptide, a CD40L polypeptide, a 4-1BBL polypeptide, a TGF-β polypeptide, a *Clostridium difficile* TcdA polypeptide, a *C. difficile* TcdB polypeptide, or a biologically active fragment thereof. The coronavirus Spike polypeptide can be fused to the adjuvant polypeptide. The coronavirus Spike polypeptide fused to the adjuvant polypeptide can consist essentially of or can consist of an amino acid sequence set forth in SEQ ID NO:5. The SC-Ad also can include a nucleic acid sequence encoding a chaff polypeptide. The chaff polypeptide can be a fragment of an ACE2 polypeptide. The fragment of an ACE2 polypeptide can include the extracellular region of an ACE2 polypeptide and can lack a transmembrane domain. The chaff polypeptide can consist essentially of or can consist of an amino acid sequence set forth in SEQ ID NO:8 or SEQ ID NO:9.

In another aspect, this document features a composition including a SC-Ad, where the SC-Ad has a genome lacking at least a portion of a nucleic acid sequence that encodes an adenovirus polypeptide, where the SC-Ad includes the adenovirus polypeptide, and where the SC-Ad includes (a) a nucleic acid sequence encoding an immunogen and (b) a nucleic acid sequence encoding an adjuvant polypeptide.

In another aspect, this document features methods for inducing an immune response against a virus in a mammal. The methods can include, or consist essentially of, administering to a mammal i) a SC-Ad, where the SC-Ad has a genome lacking at least a portion of a nucleic acid sequence that encodes an adenovirus polypeptide, where the SC-Ad includes the adenovirus polypeptide, and where the SC-Ad includes (a) a nucleic acid sequence encoding an immunogen and (b) a nucleic acid sequence encoding an adjuvant polypeptide; or ii) a composition that includes a SC-Ad, where the SC-Ad has a genome lacking at least a portion of a nucleic acid sequence that encodes an adenovirus polypeptide, where the SC-Ad includes the adenovirus polypeptide, and where the SC-Ad includes (a) a nucleic acid sequence encoding an immunogen and (b) a nucleic acid sequence encoding an adjuvant polypeptide, under conditions where the SC-Ad infects a cell of the mammal, and where expression of the immunogen in the cell leads to induction of the immune response. The mammal can be a human. The virus can be a coronavirus, and the immunogen can be associated with the coronavirus. The coronavirus can be a betacoronavirus. The betacoronavirus can be SARS-CoV-2. The administering can include mucosal delivery of the SC-Ad.

In another aspect, this document features a SC-Ad, where the SC-Ad has a genome which lacks at least a portion of a nucleic acid sequence that encodes an adenovirus polypeptide, where the SC-Ad includes the adenovirus polypeptide, and where the SC-Ad includes (a) a nucleic acid sequence encoding an immunogen and (b) a nucleic acid sequence encoding a chaff polypeptide. The adenovirus polypeptide can be a fiber polypeptide, a V polypeptide, a hexon polypeptide, a penton base polypeptide, or a pIIIa polypeptide. The immunogen can be a coronavirus immunogen. The coronavirus immunogen can include a coronavirus Spike polypeptide or an immunogenic fragment thereof. The coronavirus immunogen can consist of or can consist essentially of an amino acid sequence set forth in any one of SEQ ID NOs:1-4. The chaff polypeptide can be a fragment of an ACE2 polypeptide. The fragment of an ACE2 polypeptide can include the extracellular region of an ACE2 polypeptide and can lack a transmembrane domain. The chaff polypeptide can consist essentially of or can consist of an amino acid sequence set forth in SEQ ID NO:8 or SEQ ID NO:9. The coronavirus Spike polypeptide can be fused to the chaff polypeptide. The SC-Ad also can include a nucleic acid sequence encoding an adjuvant polypeptide. The adjuvant polypeptide can be a GM-CSF polypeptide, an IL-4 polypeptide, an IL-21 polypeptide, a CD40L polypeptide, a 4-1BBL polypeptide, a TGF-β polypeptide, a *Clostridium difficile* TcdA polypeptide, a *C. difficile* TcdB polypeptide, or a biologically active fragment thereof.

In another aspect, this document features for a composition including a SC-Ad, where the SC-Ad has a genome which lacks at least a portion of a nucleic acid sequence that encodes an adenovirus polypeptide, where the SC-Ad includes the adenovirus polypeptide, and where the SC-Ad includes (a) a nucleic acid sequence encoding an immunogen and (b) a nucleic acid sequence encoding a chaff polypeptide.

In another aspect, this document features methods for inducing an immune response against a virus in a mammal. The methods can include, or consist essentially of, administering to a mammal i) a SC-Ad, where the SC-Ad has a genome which lacks at least a portion of a nucleic acid sequence that encodes an adenovirus polypeptide, where the SC-Ad includes the adenovirus polypeptide, and where the SC-Ad includes (a) a nucleic acid sequence encoding an immunogen and (b) a nucleic acid sequence encoding a chaff polypeptide, or ii) a composition including a SC-Ad, where the SC-Ad has a genome which lacks at least a portion of a nucleic acid sequence that encodes an adenovirus polypeptide, where the SC-Ad includes the adenovirus polypeptide, and where the SC-Ad includes (a) a nucleic acid sequence encoding an immunogen and (b) a nucleic acid sequence encoding a chaff polypeptide, under conditions where the SC-Ad infects a cell of the mammal, and where expression of the immunogen in the cell leads to induction of the immune response. The mammal can be a human. The virus can be a coronavirus, and the immunogen can be associated with the coronavirus. The coronavirus can be a betacoronavirus. The betacoronavirus can be SARS-CoV-2. The administering can include mucosal delivery of the SC-Ad.

In another aspect, this document features for a SC-Ad, where the SC-Ad has a genome which lacks at least a portion of a nucleic acid sequence that encodes an adenovirus polypeptide, where the SC-Ad includes the adenovirus polypeptide, and where the SC-Ad includes (a) a nucleic acid sequence encoding an immunogen, (b) a nucleic acid sequence encoding an adjuvant polypeptide, and (c) a nucleic acid sequence encoding a chaff polypeptide. The adenovirus polypeptide can be a fiber polypeptide, a V polypeptide, a hexon polypeptide, a penton base polypeptide, or a pIIIa polypeptide. The immunogen can be a coronavirus immunogen. The coronavirus immunogen can include a coronavirus Spike polypeptide or an immunogenic fragment thereof. The coronavirus immunogen can consist of or can consist essentially of an amino acid sequence set forth in any one of SEQ ID NOs:1-4. The adjuvant polypeptide can be a GM-CSF polypeptide, an IL-4 polypeptide, an IL-21 polypeptide, a CD40L polypeptide, a 4-1BBL polypeptide, a TGF-β polypeptide, a *Clostridium difficile* TcdA polypeptide, a *C. difficile* TcdB polypeptide, or a biologically active fragment thereof. The chaff polypeptide can be a fragment of an ACE2 polypeptide. The fragment of an ACE2 polypeptide can include the extracellular region of an ACE2 polypeptide and can lack a transmembrane domain. The chaff polypeptide can consist essentially of or can consist of an amino acid sequence set forth in SEQ ID NO:8 or SEQ ID NO:9.

In another aspect, this document features for a composition including a SC-Ad, where the SC-Ad has a genome which lacks at least a portion of a nucleic acid sequence that encodes an adenovirus polypeptide, where the SC-Ad includes the adenovirus polypeptide, and where the SC-Ad includes (a) a nucleic acid sequence encoding an immunogen, (b) a nucleic acid sequence encoding an adjuvant polypeptide, and (c) a nucleic acid sequence encoding a chaff polypeptide.

In another aspect, this document features methods for inducing an immune response against a virus in a mammal. The methods can include, or consist essentially of, administering to a mammal i) a SC-Ad, where the SC-Ad has a genome which lacks at least a portion of a nucleic acid sequence that encodes an adenovirus polypeptide, where the SC-Ad includes the adenovirus polypeptide, and where the SC-Ad includes (a) a nucleic acid sequence encoding an immunogen, (b) a nucleic acid sequence encoding an adjuvant polypeptide, and (c) a nucleic acid sequence encoding a chaff polypeptide, or ii) a composition including a SC-Ad, where the SC-Ad has a genome which lacks at least a portion of a nucleic acid sequence that encodes an adenovirus polypeptide, where the SC-Ad includes the adenovirus polypeptide, and where the SC-Ad includes (a) a nucleic acid sequence encoding an immunogen, (b) a nucleic acid sequence encoding an adjuvant polypeptide, and (c) a nucleic acid sequence encoding a chaff polypeptide, under conditions where the SC-Ad infects a cell of the mammal, and where expression of the immunogen in the cell leads to induction of the immune response. The mammal can be a human. The virus can be a coronavirus, and the immunogen can be associated with the coronavirus. The coronavirus can be a betacoronavirus. The betacoronavirus can be SARS-CoV-2. The administering can include mucosal delivery of the SC-Ad.

In another aspect, this document features for a SC-Ad, where the SC-Ad has a genome lacking at least a portion of a nucleic acid sequence that encodes an adenovirus polypeptide, where the SC-Ad includes the adenovirus polypeptide, and where the SC-Ad includes a nucleic acid sequence encoding an immunogen expressed by or shed by an allergen. The adenovirus polypeptide can be a fiber polypeptide, a V polypeptide, a hexon polypeptide, a penton base polypeptide, or a pIIIa polypeptide. The SC-Ad also can include a nucleic acid sequence encoding an adjuvant polypeptide. The adjuvant polypeptide can be a GM-CSF polypeptide, an IL-4 polypeptide, an IL-21 polypeptide, a CD40L polypeptide, a 4-1BBL polypeptide, a TGF-β polypeptide, a *Clostridium difficile* TcdA polypeptide, a *C. difficile* TcdB polypeptide, or a biologically active fragment thereof. The SC-Ad also can include a nucleic acid sequence encoding a chaff polypeptide. The chaff polypeptide can be a fragment of an ACE2 polypeptide. The fragment of an ACE2 polypeptide can include the extracellular region of an ACE2 polypeptide and can lack a transmembrane domain. The chaff polypeptide can consists essentially of or consists of an amino acid sequence set forth in SEQ ID NO:8 or SEQ ID NO:9.

In another aspect, this document features for a composition including a SC-Ad, where the SC-Ad has a genome lacking at least a portion of a nucleic acid sequence that encodes an adenovirus polypeptide, where the SC-Ad includes the adenovirus polypeptide, and where the SC-Ad includes a nucleic acid sequence encoding an immunogen expressed by or shed by an allergen.

In another aspect, this document features methods for inducing an immune response against an allergen in a mammal. The methods can include, or consist essentially of, administering to a mammal i) a SC-Ad, where the SC-Ad has a genome lacking at least a portion of a nucleic acid sequence that encodes an adenovirus polypeptide, where the SC-Ad includes the adenovirus polypeptide, and where the SC-Ad includes a nucleic acid sequence encoding an immunogen expressed by or shed by an allergen, or ii) a composition including a SC-Ad, where the SC-Ad has a genome lacking at least a portion of a nucleic acid sequence that encodes an adenovirus polypeptide, where the SC-Ad includes the adenovirus polypeptide, and where the SC-Ad includes a nucleic acid sequence encoding an immunogen expressed by or shed by an allergen, under conditions where the SC-Ad infects a cell of the mammal, and where expression of the immunogen in the cell leads to induction of the immune response. The mammal can be a human.

In another aspect, this document features for a SC-Ad, where the SC-Ad has a genome lacking at least a portion of a nucleic acid sequence that encodes an adenovirus polypeptide, where the SC-Ad includes the adenovirus polypeptide, and where the SC-Ad includes a nucleic acid sequence encoding an immunogen expressed by a cancer cell. The adenovirus polypeptide can be a fiber polypeptide, a V polypeptide, a hexon polypeptide, a penton base polypeptide, or a pIIIa polypeptide. The SC-Ad also can include a nucleic acid sequence encoding an adjuvant polypeptide. The adjuvant polypeptide can be a GM-CSF polypeptide, an IL-4 polypeptide, an IL-21 polypeptide, a CD40L polypeptide, a 4-1BBL polypeptide, a TGF-β polypeptide, a *Clostridium difficile* TcdA polypeptide, a *C. difficile* TcdB polypeptide, or a biologically active fragment thereof. The SC-Ad also can include a nucleic acid sequence encoding a chaff polypeptide. The chaff polypeptide can be a fragment of an ACE2 polypeptide. The fragment of an ACE2 polypeptide can include the extracellular region of an ACE2 polypeptide and can lack a transmembrane domain. The chaff polypeptide can consist essentially of or can consist of an amino acid sequence set forth in SEQ ID NO:8 or SEQ ID NO:9.

In another aspect, this document features for a composition including a SC-Ad, where the SC-Ad has a genome lacking at least a portion of a nucleic acid sequence that encodes an adenovirus polypeptide, where the SC-Ad includes the adenovirus polypeptide, and where the SC-Ad includes a nucleic acid sequence encoding an immunogen expressed by a cancer cell.

In another aspect, this document features methods for inducing an immune response against a cancer cell in a mammal. The methods can include, or consist essentially of, administering to a mammal i) a SC-Ad, where the SC-Ad has a genome lacking at least a portion of a nucleic acid sequence that encodes an adenovirus polypeptide, where the SC-Ad includes the adenovirus polypeptide, and where the SC-Ad includes a nucleic acid sequence encoding an immunogen expressed by a cancer cell, or ii) a composition including a SC-Ad, where the SC-Ad has a genome lacking at least a portion of a nucleic acid sequence that encodes an adenovirus polypeptide, where the SC-Ad includes the adenovirus polypeptide, and where the SC-Ad includes a nucleic acid sequence encoding an immunogen expressed by a cancer cell, under conditions where the SC-Ad infects a cell of the mammal, and where expression of the immunogen in the cell leads to induction of the immune response. The mammal can be a human.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DESCRIPTION OF THE DRAWINGS

(FIG. 1A) A TcdA/B fusion protein includes a human alpha 1-antitrypsin (AAT) secretory leader sequence and the RBDs of TcdA and TcdB that are separated by two furin cleavage sites. (FIG. 1B) A variant immunogen and, optionally, one or more adjuvants and/or one more chaff polypeptides. The polypeptide encoding sequence of pIIIA, which is normally located between 52 K and penton, is deleted.

FIG. 15. SC-Ad-Spike infects ACE2+ cells and forms cell fusion events.

FIG. 23. An exemplary SC-Ad carrying centralized influenza HA gene H1-CON covering H1 hemagglutinins and H1-5 CON covering H1-H5 hemagglutinin sequences.

FIG. 28. A sequence listing for an amino acid sequence (SEQ ID NO:1) of a SARS-CoV-2 Spike polypeptide.

FIG. 29. A sequence listing for an amino acid sequence (SEQ ID NO:2) of a SARS-CoV-2 Spike polypeptide lacking an ER retention sequence.

FIG. 30. A sequence listing for an amino acid sequence (SEQ ID NO:3) of an ectodomain of a SARS-CoV-2 Spike polypeptide.

FIG. 31. A sequence listing for an amino acid sequence (SEQ ID NO:4) of a receptor binding domain of a SARS-CoV-2 Spike polypeptide.

FIG. 32. A sequence listing for an amino acid sequence (SEQ ID NO:5) of a receptor binding domain of a SARS-CoV-2 Spike polypeptide fused to an Ig polypeptide.

FIG. 33. A sequence listing for an amino acid sequence (SEQ ID NO:6) of a receptor binding domain of a SARS-CoV-2 Spike polypeptide fused to a streptavidin polypeptide.

FIG. 34. A sequence listing for an amino acid sequence (SEQ ID NO:7) of a receptor binding domain of a SARS-CoV-2 Spike polypeptide fused to a sigma coil polypeptide.

FIG. 35. A sequence listing for an amino acid sequence (SEQ ID NO:8) of an ectodomain of an ACE2 chaff polypeptide.

FIG. 36. A sequence listing for an amino acid sequence (SEQ ID NO:9) of an inactivated ectodomain of an ACE2 chaff polypeptide.

FIGS. 37A-37C. Sequence listings for amino acid sequences of adjuvant polypeptides derived from a C. difficile toxin. (FIG. 37A) A sequence listing for an amino acid sequence (SEQ ID NO:22) of a TcdA polypeptide. (FIG. 37B) A sequence listing for an amino acid sequence (SEQ ID NO:23) of a TcdB polypeptide. (FIG. 37C) A sequence listing for an amino acid sequence (SEQ ID NO:10) of a TcdA/B fusion polypeptide.

FIG. 38. A sequence listing for an amino acid sequence (SEQ ID NO:11) of a SARS-CoV-2 ORF1ab polypeptide.

FIG. 39. A sequence listing for an amino acid sequence (SEQ ID NO:12) of a SARS-CoV-2 S polypeptide.

FIG. 40. A sequence listing for an amino acid sequence (SEQ ID NO:13) of a SARS-CoV-2 ORF3 polypeptide.

FIG. 41. A sequence listing for an amino acid sequence (SEQ ID NO:14) of a SARS-CoV-2 E polypeptide.

FIG. 42. A sequence listing for an amino acid sequence (SEQ ID NO:15) of a SARS-CoV-2 M polypeptide.

FIG. 43. A sequence listing for an amino acid sequence (SEQ ID NO:16) of a SARS-CoV-2 ORF3 polypeptide.

FIG. 44. A sequence listing for an amino acid sequence (SEQ ID NO:17) of a SARS-CoV-2 ORF7 polypeptide.

FIG. 45. A sequence listing for an amino acid sequence (SEQ ID NO:18) of a SARS-CoV-2 ORF8 polypeptide.

FIG. 46. A sequence listing for an amino acid sequence (SEQ ID NO:19) of a SARS-CoV-2 N polypeptide.

FIG. 47. A sequence listing for an amino acid sequence (SEQ ID NO:20) of a centralized H1 influenza hemagglutinin polypeptide.

FIG. 48. A sequence listing for an amino acid sequence (SEQ ID NO:21) of a centralized H1-5 influenza hemagglutinin polypeptide.

FIG. 49. A sequence listing for a nucleic acid sequence (SEQ ID NO:24) that can encode a TcdA polypeptide derived from a C. difficile toxin.

FIG. 50. A sequence listing for a nucleic acid sequence (SEQ ID NO:25) that can encode a TcdB polypeptide derived from a C. difficile toxin.

FIG. 51. A sequence listing for nucleic acid sequence (SEQ ID NO:26) that can encode a SC-Ad-Spike virus.

FIG. 52. A sequence listing for nucleic acid sequence (SEQ ID NO:27) that can encode a SC-Ad-TcdA/B virus.

FIG. 53. A sequence listing for a SC-Ad6-ΔIII-ΔE3-CMV-Spike-3X-LZL nucleic acid (SEQ ID NO:28).

FIG. 54. A sequence listing for a SC-Ad6-ΔIII-ΔE3-CMV-Spike-PP-3X-LZL nucleic acid (SEQ ID NO:29).

FIG. 55. A sequence listing for a SC-Ad6-ΔIII-ΔE3ADP-I-CMV-Spike-3X-L nucleic acid (SEQ ID NO:30).

FIG. 56. A sequence listing for a SC-Ad6-ΔIII-ΔE3ADP-I-CMV-Spike-PP-3X-L nucleic acid (SEQ ID NO:31).

FIG. 57. A sequence listing for a SC-Ad-FZF-657-ΔIIIF-ΔE3-Spike-3X-L nucleic acid (SEQ ID NO:32).

FIG. 58. A sequence listing for a SC-Ad-FZF-657-ΔIIIF-ΔE3-SpikePP-3X-L nucleic acid (SEQ ID NO:33).

FIG. 59. A sequence listing for a SC-Ad-FZF-C68-ΔIIIF-ΔE3-Spike-3X-L nucleic acid (SEQ ID NO:34).

FIG. 60. A sequence listing for a SC-Ad-FZF-C68-ΔIIIF-ΔE3-SpikePP-3X-L nucleic acid (SEQ ID NO:35).

FIG. 61. A sequence listing for a SC-Ad-F-657-ΔIIIF-ΔF3-Spike-3X-L nucleic acid (SEQ ID NO:36).

FIG. 62. A sequence listing for a SC-Ad-F-657-ΔIIIF-ΔF3-SpikePP-3X-L nucleic acid (SEQ ID NO:37).

FIG. 63. A sequence listing for a SC-Ad-F-C68-ΔIIIF-ΔF3-Spike-3X-L nucleic acid (SEQ ID NO:38).

FIG. 64. A sequence listing for a SC-Ad-F-C68-ΔIIIF-ΔF3-SpikePP-3X-L nucleic acid (SEQ ID NO:39).

DETAILED DESCRIPTION

Figure 1A:
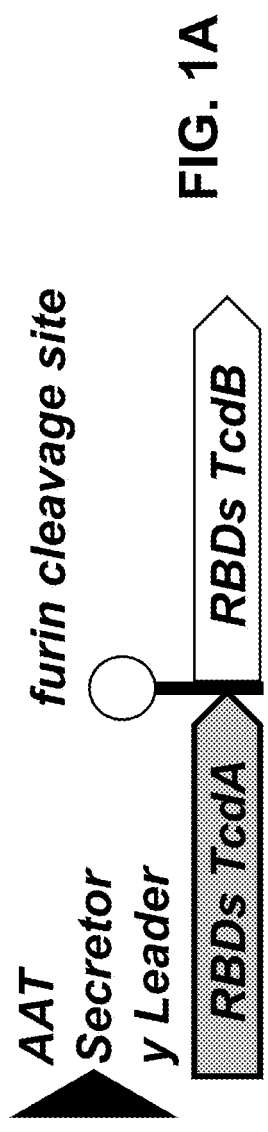
FIGS. 1A-1B. Schematic of an exemplary TcdA/B fusion protein and an exemplary SC-Ad6 plasmid expressing a fusion protein according to some embodiments.

This document provides adenovirus vectors and methods and materials for using adenovirus vectors. In some cases, adenovirus vectors encoding one or more (e.g., one, two, three, four, five, six, seven, eight, nine, ten, or more) immunogens can be used to deliver immunogens to a mammal (e.g., a human) such that the mammal produces an effective immune response (e.g., an immune response against those immunogens). For example, adenovirus vectors encoding one or more immunogens can be used to deliver immunogens to a mammal (e.g., a human) such that the mammal produces antibodies against a pathogen, allergen, and/or cancer cell associated with those immunogens. In some cases, nucleic acid molecules that can encode an adenovirus vector encoding one or more immunogens can be used to deliver immunogens to a mammal (e.g., a human) such that the mammal produces an effective immune response (e.g., an immune response against those immunogens). For example, nucleic acid molecules that can encode an adenovirus vector encoding one or more immunogens can be used to deliver immunogens to a mammal (e.g., a human) such that the mammal produces antibodies against a pathogen, allergen, and/or cancer cell associated with those immunogens.

This document also provides adenovirus vectors encoding one or more (e.g., one, two, three, four, five, six, seven, eight, nine, ten, or more) immunogens (e.g., SC-Ads encoding one or more immunogens), nucleic acid molecules encoding adenovirus vectors encoding one or more immunogens, cell lines containing adenovirus vectors encoding one or more immunogens, methods for using adenovirus vectors encoding one or more immunogens to deliver the immunogen(s) to cells in vitro or in vivo, and methods for using adenovirus vectors encoding one or more immunogens to induce immune responses within a mammal (e.g., a human).

An adenovirus vector provided herein (e.g., an adenovirus vector encoding one or more immunogens) can be derived from any adenovirus. An adenovirus used to create an adenovirus vector provided herein can be any appropriate serotype (e.g., Ad1-Ad57). In some cases, an adenovirus can be a replication competent adenovirus. In some cases, an adenovirus can be a replication defective adenovirus. In some cases, an adenovirus can be capable of infecting a human cell (e.g., can be a human adenovirus). In some cases, an adenovirus can be capable of infection a non-human cell (e.g., can be a non-human adenovirus) such as chimpanzee cells. Examples of adenoviruses that can be used to make an adenovirus vector provided herein include, without limitation, Ad5 adenoviruses, Ad6 adenoviruses, ChAdOx1, and ChAdOx2.

In some cases, an adenovirus vector provided herein (e.g., an adenovirus vector encoding one or more immunogens) can be a SC-Ad. A SC-Ad can have a genome which lacks all or a portion of at least of one of the following adenovirus nucleic acid sequences: fiber protein-encoding sequence, V protein-encoding sequence, hexon-encoding sequence, penton base-encoding sequence (also referred to as a pIII-encoding sequence), VA RNA-encoding sequence, pIIIa protein-encoding sequence (also referred to as a minor capsid protein-encoding sequence), or other early or late gene product-encoding sequences. Examples of nucleic acid sequences that encode adenoviral polypeptides include, without limitation, those set forth in GenBank gi numbers 209842, 58478, or 2935210, and/or annotated in GenBank accession numbers M73260, X17016, or AF030154. In some cases, a deletion of all or a portion of the nucleic acid encoding one or more of the following polypeptides can be engineered into a nucleic acid encoding an adenovirus such that the adenovirus vector does not encode that full-length adenovirus polypeptide or a fully functional version of that adenovirus polypeptide: fiber protein-encoding sequence, V protein-encoding sequence, hexon-encoding sequence, penton base-encoding sequence, VA RNA-encoding sequence, pIIIa protein-encoding sequence, or other early or late gene product-encoding sequences. Such deletions can be any length that results in the deletion of one or more encoded amino acids and in a reduction or elimination of the normal function of that polypeptide. For example, portions of a nucleic acid sequence of an adenovirus can be removed such that the otherwise encoded polypeptide lacks 5, 6, 7, 8, 9, 10, 15, 20, 25, 30, or more amino acid residues and lacks its normal activity. The portion or portions to be deleted can be removed from any location along the length of the sequence. For example, a portion of an adenovirus nucleic acid sequence can be removed at the 5' end, the 3' end, or an internal region of an adenovirus nucleic acid such as a fiber protein-encoding sequence, V protein-encoding sequence, hexon-encoding sequence, penton base-encoding sequence, VA RNA-encoding sequence, pIIIa protein-encoding sequence, or other early or late gene product-encoding sequences. In some cases, a SC-Ad can be as described elsewhere (see, e.g., Matchett et al., *J. of Virol.*, 2019 93(10):e02016-18 (2019); and International PCT Patent Application Publication No. WO 2009/111738).

An adenovirus vector provided herein (e.g., an adenovirus vector encoding one or more immunogens) can include a nucleic acid sequence encoding any appropriate immunogen (e.g., a nucleic acid that drives expression of any appropriate immunogen). In some cases, an immunogen can be an antigen. An immunogen can be a full-length immunogenic polypeptide or a portion thereof (e.g., can be derived from an immunogenic polypeptide).

When an immunogenic polypeptide is from a pathogen, the immunogenic polypeptide can be from any type of pathogen (e.g., a virus, a bacterium, a protozoan, a prion, a viroid, or a fungus). In some cases, an immunogenic polypeptide can be a polypeptide expressed by a virus (e.g., a viral polypeptide). For example, an immunogenic polypeptide can be a polypeptide expressed by a coronavirus (e.g., a beta-coronavirus). Examples of viruses that can express an immunogenic polypeptide include, without limitation, SARS-CoV, HCoV NL63, HKU1, MERS-CoV, SARS-CoV-2, HIV-1, hepatitis B virus, hepatitis C virus, hepatitis D virus, hepatitis E virus, influenza, Ebola virus, Chiningunya virus, Zika virus, cytomegalovirus, West Nile virus, and those described in Table 3-1 of "Learning from SARS: Preparing for the Next Disease Outbreak: Workshop Summary." Institute of Medicine (US) Forum on Microbial Threats; Knobler S, Mahmoud A, Lemon S, et al., editors.

Washington (DC): National Academies Press (US); 2004. In some cases, an immunogen can be derived from a polypeptide expressed by a bacterium (e.g., a bacterial polypeptide). Examples of bacteria that express polypeptides from which an immunogen can be derived include, without limitation, *Clostridium* (e.g., *C. difficile*), *Staphylococcus aureus* (e.g. methicillin-resistant *S. aureus*), *Campylobacter* (e.g. *Campylobacter jejuni*), Mycobacteria (e.g. *M. tuberculosis*), and *Borrelia* (*B. burgdorferi*). Examples of immunogenic polypeptides that can be expressed by a pathogen include, without limitation, *C. difficile* Toxin A (TcdA) polypeptides, *C. difficile* Toxin B (TcdB) polypeptides, coronavirus Spike polypeptides, the amino acid sequence set forth in SEQ ID NO:1 (see, e.g., FIG. 28), coronavirus nucleoproteins, coronavirus membrane proteins, coronavirus envelope proteins, and coronavirus non-structural proteins (e.g., coronavirus non-structural proteins 1-16). For example, an immunogenic polypeptide associated with a pathogen can have, or can be encoded by, a sequence set forth in, for example, National Center for Biotechnology Information (NCBI) Accession Nos: MN938384 and AY772062.

When an immunogenic polypeptide is from an allergen, the immunogenic polypeptide can be from any type of allergen (e.g., a substance capable of triggering an immune response that results in an allergic reaction). Examples of allergens that can express and/or shed an immunogenic polypeptide include, without limitation, Fel d 7, Can f1, beta-lactoglobulin, prolamin, parvalbumin, gliadin, Fel dl, chitinase, glutenin, cupin, prolamin, profilins, polcalcins, bet v-1-related proteins, 2S albumins, vicilins, legumins, nsLTPs, and Aed a 2. For example, adenovirus vectors encoding one or more immunogens described herein can be used to deliver immunogens to a mammal (e.g., a human) such that the mammal produces antibodies against an allergen associated with those immunogens. For example, nucleic acid molecules that can encode an adenovirus vector encoding one or more immunogens can be used to deliver immunogens to a mammal (e.g., a human) such that the mammal produces antibodies against an allergen associated with those immunogens. For example, an immunogenic polypeptide associated with an allergen can have, or can be encoded by, a sequence set forth in, for example, NCBI Accession Nos: NP_001363134.1, AAD56719, NP_001363136.1, NP_001363139.1, P27762.1, P10414.2, P15494.2, P43176.2, NP_001191706.1, NP_001003190.1, XP_030099003.1, or XP_001657779.1.

When an immunogenic polypeptide is from a cancer cell (e.g., a cancer cell within a mammal having cancer), the immunogenic polypeptide can be expressed by any cancer cell. For example, an immunogenic polypeptide expressed by a cancer cell can be a tumor antigen. In some cases, an immunogenic polypeptide expressed by a cancer cell can be a cell surface tumor antigen. In some cases, an immunogenic polypeptide expressed by a cancer cell can be a tumor-associated antigen (TAA; e.g., an antigen, such as an abnormal protein, present on tumor cells). In some cases, an immunogenic polypeptide can be a tumor-specific antigen (TSA; e.g., an antigen present only on tumor cells). Examples of immunogenic polypeptides that can be expressed by a cancer cell and used as described herein include, without limitation, folate receptor alpha, mucin 1 (MUC-1), human epidermal growth factor receptor 2 (HER-2), estrogen receptor (ER), epidermal growth factor receptor (EGFR), folate receptor alpha, mesothelin, alphafetoprotein (AFP), carcinoembryonic antigen (CEA), CA-125, epithelial tumor antigen (ETA), melanoma-associated antigen (MAGE), antigens produced by Epstein-Barr Viruses, and antigens produced by human papilloma viruses. For example, adenovirus vectors encoding one or more immunogens as described herein can be used to deliver immunogens to a mammal (e.g., a human) such that the mammal produces antibodies against cancer cells associated with those immunogens. For example, nucleic acid molecules that can encode an adenovirus vector encoding one or more immunogens as described herein can be used to deliver immunogens to a mammal (e.g., a human) such that the mammal produces antibodies against cancer cells associated with those immunogens. For example, an immunogenic polypeptide associated with a cancer cell can have, or can be encoded by, a sequence set forth in, for example, NCBI Accession Nos: XP_002754883.1, AAA03229.1, Q02496.2, AAD33253.1, CEQ32409.1, YP_401631.1, YP_401632.1, or QAR15051.1.

When an immunogenic polypeptide is from a cancer cell (e.g., a cancer cell within a mammal having cancer), the immunogenic polypeptide can be expressed by any type of cancer cell. Examples of such cancers include, without limitation, lung cancers, breast cancers, prostate cancers, liver cancer, kidney cancers, brain cancers, B cell cancers, T cell cancers, ovarian cancers, and skin cancers.

An immunogen can be a full-length immunogenic polypeptide or a portion thereof (e.g., can be derived from an immunogenic polypeptide). For example, a nucleic acid sequence encoding an immunogenic polypeptide can be modified to remove portions of nucleic acid such that the encoded polypeptide lacks any number of amino acids (e.g., 5, 10, 15, 20, 30 amino acids, or all amino acids of the immunogenic polypeptide). In some cases, portions of a nucleic acid sequence encoding an immunogenic polypeptide can be removed from anywhere along the length of the sequence. For example, portions of the nucleic acid sequence can be removed at the 5' end, the 3' end, or an internal region of the target nucleic acid. In some cases, an immunogen can be designed to be secreted from cells infected with the adenovirus vector encoding the immunogen. For example, a nucleic acid sequence encoding an ER retention sequence can be removed from a nucleic acid sequence encoding an immunogen (e.g., such that the encoded immunogen lacks an ER retention sequence). In some cases, an immunogen can be designed to extend from cells infected with the adenovirus vector encoding the immunogen into the extracellular space. For example, an immunogen can include an ectodomain of an immunogenic polypeptide. In some cases, an immunogen can bind (e.g., can be designed to bind) to viral receptor (e.g., an ACE2 polypeptide). For example, an immunogen can include a receptor binding domain of an immunogenic polypeptide. Examples of immunogens derived from immunogenic polypeptides that can be used as described herein include, without limitation, the amino acid sequence set forth in SEQ ID NO:2 (see, e.g., FIG. 29), the amino acid sequence set forth in SEQ ID NO:3 (see, e.g., FIG. 30), the amino acid sequence set forth in SEQ ID NO:4 (see, e.g., FIG. 31), the amino acid sequence set forth in SEQ ID NO:11 (see, e.g., FIG. 38), the amino acid sequence set forth in SEQ ID NO:12 (see, e.g., FIG. 39), the amino acid sequence set forth in SEQ ID NO:13 (see, e.g., FIG. 40), the amino acid sequence set forth in SEQ ID NO:14 (see, e.g., FIG. 41), the amino acid sequence set forth in SEQ ID NO:15 (see, e.g., FIG. 42), the amino acid sequence set forth in SEQ ID NO:16 (see, e.g., FIG. 43), the amino acid sequence set forth in SEQ ID NO:17 (see, e.g., FIG. 44), the amino acid sequence set forth in SEQ ID NO:18 (see, e.g., FIG. 45), and the amino acid sequence set forth in SEQ ID NO:19 (see, e.g., FIG. 46).

In some cases, an immunogen described herein can be a variant of a wild-type immunogen. For example, a variant of a coronavirus Spike polypeptide (e.g., a SARS-CoV-2 Spike polypeptide) can comprise or consist essentially of an amino acid sequence set forth in any one of SEQ ID NOs:1-4 with one or more (e.g., one, two, three, four, five, six, seven, eight, nine, ten, or more) amino acid deletions, additions, substitutions, or combinations thereof.

In some cases, an immunogen described herein can have an amino acid sequence with at least 85% sequence identity (e.g., at least 88% sequence identity, at least 90% sequence identity, at least 93% sequence identity, at least 95% sequence identity, at least 97% sequence identity, at least 98% sequence identity, or at least 99% sequence identity) to the amino acid sequence set forth in any one of SEQ ID NOs:1-4.

The percent sequence identity between a particular amino acid sequence and a sequence referenced by a particular sequence identification number is determined as follows. First, an amino acid sequence is compared to the sequence set forth in a particular sequence identification number using the BLAST 2 Sequences (Bl2seq) program from the stand-alone version of BLASTZ containing BLASTN version 2.0.14 and BLASTP version 2.0.14. This stand-alone version of BLASTZ can be obtained online at fr.com/blast or at ncbi.nlm.nih.gov. Instructions explaining how to use the Bl2seq program can be found in the readme file accompanying BLASTZ. Bl2seq performs a comparison between two sequences using either the BLASTN or BLASTP algorithm. BLASTN is used to compare nucleic acid sequences, while BLASTP is used to compare amino acid sequences. To compare two nucleic acid sequences, the options are set as follows: -i is set to a file containing the first nucleic acid sequence to be compared (e.g., C:\seq1.txt); -j is set to a file containing the second nucleic acid sequence to be compared (e.g., C:\seq2.txt); -p is set to blastn; -o is set to any desired file name (e.g., C:\output.txt); -q is set to -1; -r is set to 2; and all other options are left at their default setting. For example, the following command can be used to generate an output file containing a comparison between two sequences: C:\Bl2seq -i c:\seq1.txt -j c:\seq2.txt -p blastn -o c:\output.txt -q -1 -r 2. To compare two amino acid sequences, the options of Bl2seq are set as follows: -i is set to a file containing the first amino acid sequence to be compared (e.g., C:\seq1.txt); -j is set to a file containing the second amino acid sequence to be compared (e.g., C:\seq2.txt); -p is set to blastp; -o is set to any desired file name (e.g., C:\output.txt); and all other options are left at their default setting. For example, the following command can be used to generate an output file containing a comparison between two amino acid sequences: C:\Bl2seq -i c:\seq1.txt -j c:\seq2.txt -p blastp -o c:\output.txt. If the two compared sequences share homology, then the designated output file will present those regions of homology as aligned sequences. If the two compared sequences do not share homology, then the designated output file will not present aligned sequences. Once aligned, the number of matches is determined by counting the number of positions where an identical nucleotide or amino acid residue is presented in both sequences. A matched position refers to a position in which identical amino acid occur at the same position in aligned sequences. The percent sequence identity is determined by dividing the number of matches by the length of the sequence set forth in the identified sequence (e.g., SEQ ID NO:1, SEQ ID NO:2, SEQ ID NO:3, or SEQ ID NO:4), followed by multiplying the resulting value by 100. For example, an amino acid sequence that has 220 matches when aligned with the sequence set forth in SEQ ID NO:2 is 93.2 percent identical to the sequence set forth in SEQ ID NO:2 (i.e., 220÷236×100=93.2). It is noted that the percent sequence identity value is rounded to the nearest tenth. For example, 75.1, 75.2, 75.3, and 75.4 is rounded down to 75, while 75.5, 75.6, 75.7, 75.8, and 75.9 is rounded up to 76. It also is noted that the length value will always be an integer.

In some cases, a coronavirus Spike polypeptide variant can contain the entire amino acid sequence set forth in any one of SEQ ID NOs:1-4, except that the amino acid sequence contains from one to ten (e.g., one to nine, two to nine, one to eight, two to eight, one to seven, one to six, one to five, one to four, one to three, two, or one) amino acid additions, deletions, substitutions, or combinations thereof, provided that the coronavirus Spike polypeptide variant has the ability to induce an immune response against a coronavirus within a mammal (e.g., a human). In some cases, a coronavirus Spike polypeptide variant can consist essentially of the amino acid sequence set forth in any one of SEQ ID NOs:1-4 except that the amino acid sequence contains one, two, three, four, or five amino acid residues preceding the articulated sequence of the sequence identifier (e.g., SEQ ID NO:1), and/or has one, two, three, four, or five amino acid residues following the articulated sequence of the sequence identifier (e.g., SEQ ID NO:1), provided that the coronavirus Spike polypeptide has the ability to induce an immune response against a coronavirus within a mammal (e.g., a human).

In some cases, an adenovirus vector provided herein (e.g., an adenovirus vector encoding one or more immunogens) can include nucleic acid sequence encoding two or more (e.g., two, three, four, five, six, seven, eight, nine, ten, or more) immunogens from different immunogenic polypeptides. For example, an adenovirus vector provided herein can include nucleic acid sequence encoding an immunogen derived from a first pathogen (e.g., an immunogen derived from an immunogenic polypeptide expressed by SARS-CoV-2) and can include nucleic acid sequence encoding an immunogen derived from a second pathogen (e.g., an immunogen derived from an immunogenic polypeptide expressed by a pathogen other than SARS-CoV-2). In some cases, an adenovirus vector provided herein that includes a nucleic acid sequence encoding two or more immunogens derived from an immunogenic polypeptide expressed by different pathogens can include nucleic acid sequence encoding a polypeptide comprising, consisting of, or consisting essentially of the amino acid sequence set forth in any one of SEQ ID NOs:1-4 and can include nucleic acid sequence encoding a polypeptide comprising, consisting of, or consisting essentially of the amino acid sequence set forth in any one of SEQ ID NOs:20-21. When an adenovirus vector provided herein includes nucleic acid sequence encoding two or more immunogens from immunogenic polypeptides expressed by different pathogens, the adenovirus vector can be used to induce an immune response against two or more pathogens.

In some cases, an adenovirus vector provided herein (e.g., an adenovirus vector encoding one or more immunogens) can include nucleic acid sequence encoding two or more (e.g., two, three, four, five, six, seven, eight, nine, ten, or more) immunogens from the same immunogenic polypeptide and/or the same pathogen. For example, an adenovirus vector provided herein can include nucleic acid sequence encoding two or more immunogens derived from the same pathogen. In some cases, an adenovirus vector provided herein that includes a nucleic acid sequence encoding two or more immunogens derived from an immunogenic polypeptide expressed by influenza can include nucleic acid sequence encoding a polypeptide comprising, consisting of, or consisting essentially of the amino acid sequence set forth in SEQ ID NO:20 (see, e.g., FIG. 47) and can include nucleic acid sequence encoding a polypeptide comprising, consisting of, or consisting essentially of the amino acid sequence set forth in SEQ ID NO:21 (see, e.g., FIG. 48).

In some cases, an adenovirus vector provided herein (e.g., an adenovirus vector encoding one or more immunogens) that includes a nucleic acid sequence encoding one or more (e.g., one, two, three, four, five, six, seven, eight, nine, ten, or more) immunogens also can include one or more regulatory sequences (e.g., an enhancer or a promoter sequence such as a constitutive, inducible, and/or tissue-specific promoter sequence) to drive transcription of the immunogen(s). Examples of enhancers and promoters that can be used to drive expression of a nucleic acid sequence encoding one or more immunogens of an adenovirus provided herein include, without limitation, a CMV enhancer sequence, a CMV promoter sequence, a CAG enhancer sequence, a CAG promoter sequence, a RSV enhancer sequence, a RSV promoter sequence, a Ef1 alpha enhancer sequence, a Ef1 alpha promoter sequence, a ubiquitin enhancer sequence, a ubiquitin promoter sequence, adenovirus enhancer sequences, and adenovirus promoter sequences. Any appropriate method can be used to detect expression of an immunogen from adenovirus vector infected cells. For example, antibodies that recognize an immunogen can be used to detect the presence or absence of the immunogen.

In some cases, an adenovirus vector provided herein (e.g., an adenovirus vector encoding one or more immunogens) can include a nucleic acid sequence encoding one or more (e.g., one, two, three, four, five, six, seven, eight, nine, ten, or more) adjuvant polypeptides (e.g., nucleic acid that drives expression of one or more adjuvant polypeptides). For example, an adenovirus vector can include a nucleic acid sequence encoding one or more polypeptides that can enhance an immune response within a mammal. In some cases, an adjuvant polypeptide can be a cytokine. In some cases, an adjuvant polypeptide can be an immune stimulator. In some cases, an adjuvant polypeptide can be a toxin. In some cases, an adjuvant polypeptide can accelerate a systemic T cell response against a pathogen present within a mammal. In some cases, an adjuvant polypeptide can increase a concentration of antibodies against a pathogen at a site where the pathogen can enter a mammal's body. For example, an adjuvant polypeptide can increase a concentration of antibodies against a virus (e.g., a coronavirus) at a mucosal site where the virus can enter a mammal's body. Examples of adjuvant polypeptides that can be encoded by an adenovirus vectors encoding one or more immunogens described herein include, without limitation, granulocyte-macrophage colony-stimulating factor (GM-CSF) polypeptides, interleukin 4 (IL-4) polypeptides, interleukin 21 (IL-21) polypeptides, CD40 ligand (CD40L) polypeptides, 4-1BB ligand (4-1BBL) polypeptides, transforming growth factor beta (TGF-β) polypeptides, *C. difficile* toxin polypeptides (e.g., *C. difficile* TcdA polypeptides (see, e.g., SEQ ID NO:22), *C. difficile* TcdB polypeptides (see, e.g., SEQ ID NO:23), and/or the amino acid sequence set forth in SEQ ID NO:10 (see, e.g., FIG. 37)), and influenza polypeptides (e.g. N polypeptides, H polypeptides, M polypeptides, the amino acid sequence set forth in SEQ ID NO:20 (see, e.g., FIG. 47), and/or the amino acid sequence set forth in SEQ ID NO:21 (see, e.g., FIG. 48)). In some cases, an adjuvant polypeptide (e.g., SEQ ID NO:22) can be preceded by an AAT secretory sequence (e.g., MPSSVSWGILLLAGLC-CLVPVSLAEDP; SEQ ID NO:28). In some cases, a nucleic acid sequence encoding an adjuvant polypeptide (e.g., SEQ ID NO:23) can be preceded by a cleavage site such as a synthetic furin cleavage site (e.g., RGRRSRGRRS; SEQ ID NO:29). Examples of nucleic acid sequences that can encoding an adjuvant polypeptide described herein include, without limitation, the nucleic acid sequence set forth in SEQ ID NO:24 (see, e.g., FIG. 49) and the nucleic acid sequence set forth in SEQ ID NO:25 (see, e.g., FIG. 50). In some cases, a nucleic acid sequence encoding an adjuvant polypeptide (e.g., SEQ ID NO:24) can be preceded by an AAT secretory sequence (e.g., ATGCCTTCATCCGTGTCATGGGGAATCCTGCTGCTGGCTGGA CTGTGCTGTCTGGTGCCTGTCTCACTGGCCGAGGACCCT; SEQ ID NO:30).

In some cases, a nucleic acid sequence encoding an adjuvant polypeptide (e.g., SEQ ID NO:25) can be preceded by a cleavage site such as a synthetic furin cleavage site (e.g., AGAGGACGGAGATCAAGAGGAAGGCGCAGC; SEQ ID NO:31). An adjuvant polypeptide can be a full-length polypeptide or a fragment of an adjuvant polypeptide described herein provided that the fragment has the ability to enhance an immune response (e.g., a biologically active fragment). In some cases, an adjuvant polypeptide can be as described elsewhere (see, e.g., Matchett et al., *Vaccines*, 8(1):64 (2020)).

In some cases, an adenovirus vector provided herein (e.g., an adenovirus vector encoding one or more immunogens) can encode (e.g., can be designed to encode) a polypeptide that includes an immunogen fused to an adjuvant polypeptide. For example, a nucleic acid sequence encoding an immunogen can be fused to a nucleic acid sequence encoding an adjuvant polypeptide (e.g., such that the encoded immunogen is fused to the encoded adjuvant polypeptide). An example of an immunogen fused to an adjuvant polypeptide that can be encoded by an adenovirus vectors encoding one or more immunogens described herein include, without limitation, the amino acid sequence set forth in SEQ ID NO:5 (see, e.g., FIG. 32).

In some cases, an adenovirus vector provided herein (e.g., an adenovirus vector encoding one or more immunogens) can include a nucleic acid sequence encoding one or more (e.g., one, two, three, four, five, six, seven, eight, nine, ten, or more) chaff polypeptides (e.g., nucleic acid that drives expression of one or more chaff polypeptides). A chaff polypeptide can be a full-length polypeptide or a fragment thereof provided that it reduces the rate of entry or inhibits entry of a pathogen into a cell within a mammal. In some cases, a chaff polypeptide can be a soluble polypeptide. For example, a soluble chaff polypeptide can be a full-length chaff polypeptide or a fragment of a chaff polypeptide that lacks a transmembrane domain. For example, a soluble chaff polypeptide can include an ectodomain of a chaff polypeptide. In some cases, a chaff polypeptide can target (e.g., target and bind to) a particular pathogen (e.g., a virus such as a coronavirus) to reduce the rate of entry or inhibit entry of the pathogen into a cell within a mammal. In some cases, a chaff polypeptide can target (e.g., target and bind to) two, three, four, five, six, or more different pathogens. In some cases, a chaff polypeptide can include one or more mutations (e.g., inactivating mutations). Examples of chaff polypeptides that can be encoded by an adenovirus vectors encoding one or more immunogens described herein include, without limitation, full-length ACE2 polypeptides and fragments thereof, full-length CD13 polypeptides and fragments thereof, full-length CEACAM1 polypeptides and fragments thereof, full-length sialydated polypeptides and fragments thereof, full-length CD46 polypeptides and fragments thereof, full-length nestin polypeptides and fragments thereof, the amino acid sequence set forth in SEQ ID NO:8 (see, e.g., FIG. 37), and the amino acid sequence set forth in SEQ ID NO:9 (see, e.g., FIG. 38).

In some cases, an adenovirus vector provided herein (e.g., an adenovirus vector encoding one or more immunogens) can encode (e.g., can be designed to encode) a polypeptide that includes an immunogen fused to a chaff polypeptide. For example, a nucleic acid sequence encoding an immunogen can include a nucleic acid sequence encoding a chaff polypeptide (e.g., such that the encoded immunogen is fused to the encoded chaff polypeptide).

In some cases, an adenovirus vector provided herein (e.g., an adenovirus vector encoding one or more immunogens) can include a nucleic acid sequence encoding one or more (e.g., one, two, three, four, five, six, seven, eight, nine, ten, or more) marker polypeptides (e.g., nucleic acid that drives expression of one or more marker polypeptides). Examples of marker polypeptides that can be encoded by an adenovirus vector encoding one or more immunogens described herein include, without limitation, fluorescent polypeptides (e.g., GFP, RFP, CFP, and YFP), streptavidin polypeptides, Cre recombinase polypeptides, Cas polypeptides, luciferase polypeptides, betagalactosidase polypeptides, and sodium iodide symporter polypeptides.

In some cases, an adenovirus vector provided herein (e.g., an adenovirus vector encoding one or more immunogens) can include a nucleic acid sequence encoding one or more (e.g., one, two, three, four, five, six, seven, eight, nine, ten, or more) polypeptides that can form a multimer (e.g., nucleic acid that drives expression of one or more polypeptides that can form a multimer). Examples of polypeptides that can form a multimer that can be encoded by an adenovirus vectors encoding one or more immunogens described herein include, without limitation, immunoglobulin constant region polypeptides (e.g., an Ig polypeptide), streptavidin polypeptides, and sigma coil polypeptides.

In some cases, an adenovirus vector provided herein (e.g., an adenovirus vector encoding one or more immunogens) can encode (e.g., can be designed to encode) a polypeptide that includes an immunogen fused to a polypeptide that can form a multimer. For example, a nucleic acid sequence encoding an immunogen can include a nucleic acid sequence encoding a polypeptide that can form a multimer (e.g., such that the encoded immunogen is fused to the encoded polypeptide that can form a multimer). Examples of immunogens fused to a polypeptide that can form a multimer that can be encoded by an adenovirus vectors encoding one or more immunogens described herein include, without limitation, the amino acid sequence set forth in SEQ ID NO:5 (see, e.g., FIG. 32), the amino acid sequence set forth in SEQ ID NO:6 (see, e.g., FIG. 33), and the amino acid sequence set forth in SEQ ID NO:7 (see, e.g., FIG. 34).

In some cases, an adenovirus vector provided herein (e.g., an adenovirus vector encoding one or more immunogens) can have a genome that is at least 85% percent identical (e.g., at least 88% sequence identical, at least 90% sequence identical, at least 93% sequence identical, at least 95% sequence identical, at least 97% sequence identical, at least 98% sequence identical, or at least 99% sequence identical) to a sequence set forth in any one of SEQ ID NOs:28-39. For example, an adenovirus vector provided herein can have a genome that comprising, consisting of, or consisting essentially of the nucleic acid sequence set forth in SEQ ID NO:28 (see, e.g., FIG. 53). For example, an adenovirus vector provided herein can have a genome that comprising, consisting of, or consisting essentially of the nucleic acid sequence set forth in SEQ ID NO:29 (see, e.g., FIG. 54). For example, an adenovirus vector provided herein can have a genome that comprising, consisting of, or consisting essentially of the nucleic acid sequence set forth in SEQ ID NO:30 (see, e.g., FIG. 55). For example, an adenovirus vector provided herein can have a genome that comprising, consisting of, or consisting essentially of the nucleic acid sequence set forth in SEQ ID NO:31 (see, e.g., FIG. 56). For example, an adenovirus vector provided herein can have a genome that comprising, consisting of, or consisting essentially of the nucleic acid sequence set forth in SEQ ID NO:32 (see, e.g., FIG. 57). For example, an adenovirus vector provided herein can have a genome that comprising, consisting of, or consisting essentially of the nucleic acid sequence set forth in SEQ ID NO:33 (see, e.g., FIG. 58). For example, an adenovirus vector provided herein can have a genome that comprising, consisting of, or consisting essentially of the nucleic acid sequence set forth in SEQ ID NO:34 (see, e.g., FIG. 59). For example, an adenovirus vector provided herein can have a genome that comprising, consisting of, or consisting essentially of the nucleic acid sequence set forth in SEQ ID NO:35 (see, e.g., FIG. 60). For example, an adenovirus vector provided herein can have a genome that comprising, consisting of, or consisting essentially of the nucleic acid sequence set forth in SEQ ID NO:36 (see, e.g., FIG. 61). For example, an adenovirus vector provided herein can have a genome that comprising, consisting of, or consisting essentially of the nucleic acid sequence set forth in SEQ ID NO:37 (see, e.g., FIG. 62). For example, an adenovirus vector provided herein can have a genome that comprising, consisting of, or consisting essentially of the nucleic acid sequence set forth in SEQ ID NO:38 (see, e.g., FIG. 63). For example, an adenovirus vector provided herein can have a genome that comprising, consisting of, or consisting essentially of the nucleic acid sequence set forth in SEQ ID NO:39 (see, e.g., FIG. 64).

In some cases, an adenovirus vector provided herein (e.g., an adenovirus vector encoding one or more immunogens) can have a genome that includes one or more of the coding regions set forth in any one of SEQ ID NOs:28-39. For example, a SC-Ad can be designed to have a genome where all the encoded polypeptides of the SC-Ad have the same amino acid sequence as those polypeptides encoded by the nucleic acid set forth in any one of SEQ ID NOs:28-39.

This document also provides nucleic acid molecules that can encode an adenovirus vector provided herein (e.g., an adenovirus vector encoding one or more immunogens such as a SC-Ad described herein). The term "nucleic acid" as used herein encompasses both RNA and DNA, including cDNA, genomic DNA, and synthetic (e.g., chemically synthesized) DNA. A nucleic acid can be double-stranded or single-stranded. A single-stranded nucleic acid can be the sense strand or the antisense strand. In addition, a nucleic acid can be circular or linear.

This document also provides cells (e.g., cell lines) containing adenovirus vectors described herein (e.g., adenovirus vectors encoding one or more immunogens such as SC-Ads described herein). In cases where an adenovirus vector lacks all or a portion of at least of one adenovirus sequences, the cells containing the adenovirus vector can provide the missing adenovirus polypeptide. For example, when the adenovirus is designed to lack nucleic acid encoding the adenovirus fiber polypeptide, an adenovirus fiber polypeptide-expressing cell line can be used to generate the adenovirus such that the adenovirus contains the fiber polypeptide (e.g., the wild-type fiber polypeptide) while lacking the nucleic acid that encodes the fiber polypeptide (e.g., the wild-type fiber polypeptide). For example, when the adenovirus is designed to lack nucleic acid encoding the V polypeptide, an adenovirus V polypeptide-expressing cell line can be used to generate the adenovirus such that the adenovirus contains the V polypeptide (e.g., the wild-type V polypeptide) while lacking the nucleic acid that encodes the V polypeptide (e.g., the wild-type V polypeptide). For example, when the adenovirus is designed to lack nucleic acid encoding the pIIIa polypeptide, an adenovirus pIIIa polypeptide-expressing cell line can be used to generate the adenovirus such that the adenovirus contains the pIIIa polypeptide (e.g., the wild-type pIIIa polypeptide) while lacking the nucleic acid that encodes the pIIIa polypeptide (e.g., the wild-type pIIIa polypeptide). In some cases, cells containing adenovirus vectors described herein can increase the available number of copies of that virus by at least 100-fold (e.g., by 100-fold to 15,000-fold, by 500- to 10,000-fold, by 5,000- to 10,000-fold, or by 5,000- to 15,000-fold). A virus can be expanded until a desired concentration is obtained in standard cell culture media (e.g., DMEM or RPMI-1640 supplemented with 5-10% fetal bovine serum at 37° C. in 5% $CO_2$). A viral titer typically is assayed by inoculating cells (e.g., A549 or 293 cells) in culture or by quantitating viral genomes by optical density or real-time PCR. In some cases, cells containing an adenovirus vector provided herein can be used to propagate the adenovirus vector (e.g., to establish a stock of the adenovirus vector). For example, a stock of the adenovirus vector can be produced by growth in mammalian cells. In some cases, a stock of the adenovirus vector can be aliquoted and frozen, and can be stored at −70° C. to −80° C. (e.g., at concentrations higher than the therapeutically effective dose). In some cases, a stock of the adenovirus vector can be stored in a stabilizing solution. Examples of stabilizing solutions include, without limitation, sugars (e.g., trehalose, dextrose, and glucose), amino acids, glycerol, gelatin, monosodium glutamate, $Ca^{2+}$, and $Mg^{2+}$.

In some cases, adenovirus vectors described herein encoding one or more immunogens (and/or nucleic acid molecules that can encode an adenovirus vector described herein encoding one or more immunogens) can be formulated into a composition (e.g., a pharmaceutical composition such as a vaccine composition) for administration to a mammal. For example, adenovirus vectors described herein encoding one or more immunogens (and/or nucleic acid molecules that can encode an adenovirus vector described herein encoding one or more immunogens) can be formulated together with one or more pharmaceutically acceptable carriers (additives), excipients, and/or diluents. Examples of pharmaceutically acceptable carriers, excipients, and diluents that can be used in a composition described herein include, without limitation, sucrose, lactose, starch (e.g., starch glycolate), cellulose, cellulose derivatives (e.g., modified celluloses such as microcrystalline cellulose, and cellulose ethers like hydroxypropyl cellulose (HPC) and cellulose ether hydroxypropyl methylcellulose (HPMC)), xylitol, sorbitol, mannitol, gelatin, polymers (e.g., polyvinylpyrrolidone (PVP), polyethylene glycol (PEG), crosslinked polyvinylpyrrolidone (crospovidone), carboxymethyl cellulose, polyethylene-polyoxypropylene-block polymers, and crosslinked sodium carboxymethyl cellulose (croscarmellose sodium)), titanium oxide, azo dyes, silica gel, fumed silica, talc, magnesium carbonate, vegetable stearin, magnesium stearate, aluminum stearate, stearic acid, antioxidants (e.g., vitamin A, vitamin E, vitamin C, retinyl palmitate, and selenium), citric acid, sodium citrate, parabens (e.g., methyl paraben and propyl paraben), petrolatum, dimethyl sulfoxide, mineral oil, serum proteins (e.g., human serum albumin), glycine, sorbic acid, potassium sorbate, water, salts or electrolytes (e.g., saline, protamine sulfate, disodium hydrogen phosphate, potassium hydrogen phosphate, sodium chloride, and zinc salts), colloidal silica, magnesium trisilicate, polyacrylates, waxes, wool fat, lecithin, and corn oil. Suitable pharmaceutical formulations depend in part upon the use and the route of administration. Such forms should not prevent the composition or formulation from reaching target cells or from exerting its effect. For example, pharmacological compositions injected into the blood stream should be soluble.

This document also provides methods for using adenovirus vectors described herein (e.g., adenovirus vectors encoding one or more immunogens) and/or nucleic acid molecules that can encode an adenovirus vector described herein. In some cases, adenovirus vectors described herein and/or nucleic acid molecules that can encode an adenovirus vector described herein can be administered to a mammal (e.g., a human) to increase an immune response (e.g., an increased antibody response and/or an increased T cell response) against a pathogen (e.g., a bacterial or a viral pathogen associated with an immunogen encoded by the adenovirus vectors). For example, adenovirus vectors described herein encoding one or more immunogens (and/or nucleic acid molecules that can encode an adenovirus vector described herein encoding one or more immunogens) can be administered to a mammal to provide the mammal with an immune response effective to reduce the severity of an infection caused by a pathogen associated with the immunogen(s) encoded by the adenovirus vectors. In some cases, adenovirus vectors described herein encoding one or more immunogens (and/or nucleic acid molecules that can encode an adenovirus vector encoding one or more immunogens) can be administered to a mammal as described herein to provide the mammal with an immune response effective to prevent the mammal from exhibiting symptoms of an infection caused by a pathogen associated with the immunogen(s) encoded by the adenovirus vectors. In some cases, adenovirus vectors described herein and/or nucleic acid molecules that can encode an adenovirus vector described herein can be administered to a mammal (e.g., a human) to increase a B cell response within the mammal. For example, adenovirus vectors described herein encoding one or more immunogens (and/or nucleic acid molecules that can encode an adenovirus vector described herein encoding one or more immunogens) can be administered to a mammal as described herein to increase the number of activated B cells (e.g., plasmablasts, plasma cells, and memory B cells) within the mammal by, for example, 10, 20, 30, 40, 50, 60, 70, 80, 90, 95, or more percent.

In some cases, adenovirus vectors described herein and/or nucleic acid molecules that can encode an adenovirus vector described herein can be administered to a mammal (e.g., a human) to increase a number of antibodies (e.g., antibodies against a pathogen such as a bacterial or a viral pathogen associated with the immunogen(s) encoded by the adenovirus vectors) within the mammal. For example, adenovirus vectors described herein encoding one or more immunogens (and/or nucleic acid molecules that can encode an adenovirus vector described herein encoding one or more immunogens) can be administered to a mammal as described herein to increase the number of antibodies within the mammal by, for example, 10, 20, 30, 40, 50, 60, 70, 80, 90, 95, or more percent. In some cases, adenovirus vectors described herein and/or nucleic acid molecules that can encode an adenovirus vector described herein can be administered to a mammal as described herein to produce antibodies against the immunogen(s) within the mammal for, for example, about one week (e.g., from about 1 to about 7 days, from about 1 to about 6 days, from about 1 to about 5 days, from about 1 to about 4 days, from about 1 to about 3 days, from about 2 to about 7 days, from about 3 to about 7 days, from about 4 to about 7 days, from about 5 to about 7 days, from about 2 to about 6 days, from about 3 to about 5 days, from about 2 to about 4 days, from about 3 to about 5 days, or from about 4 to about 6 days).

In some cases, adenovirus vectors described herein and/or nucleic acid molecules that can encode an adenovirus vector described herein can be administered to a mammal (e.g., a human) to increase a T cell response within the mammal. For example, adenovirus vectors described herein encoding one or more immunogens (and/or nucleic acid molecules that can encode an adenovirus vector described herein encoding one or more immunogens) can be administered to a mammal as described herein to increase the number of activated T cells (e.g., cytotoxic T cells and macrophages) within the mammal by, for example, 10, 20, 30, 40, 50, 60, 70, 80, 90, 95, or more percent.

Adenovirus vectors described herein (e.g., adenovirus vectors encoding one or more immunogens) and/or nucleic acid molecules that can encode an adenovirus vector described herein can be administered to any appropriate mammal (e.g., to increase an immune response against a pathogen such as a bacterial or a viral pathogen associated with the immunogen(s) encoded by the adenovirus vectors within that mammal). In some cases, the mammal can be a mammal that has not had a previous infection with a pathogen associated with an immunogen encoded by an adenovirus vector provided herein. In some cases, the mammal can be a mammal that has had a previous infection with a pathogen closely related (e.g., genetically related) to a pathogen associated with an immunogen encoded by an adenovirus vector provided herein. In some cases, the mammal can be a mammal that has an infection (e.g., an ongoing infection) with a pathogen associated with an immunogen encoded by an adenovirus vector provided herein. Examples of mammals that can be administered adenovirus vectors described herein encoding one or more immunogens (and/or nucleic acid molecules that can encode an adenovirus vector described herein encoding one or more immunogens) include, without limitation, humans, non-human primates such as monkeys, dogs, cats, horses, cows, pigs, sheep, mice, rats, rabbits, hamsters, bats, raccoons, and ferrets. In some cases, the methods and materials described herein can be applied to an avian species instead of a mammal. For example, the methods and materials described herein for treating a mammal can be applied to chickens and turkeys. In some cases, the methods and materials described herein can be applied to a species of reptile instead of a mammal. In some cases, the methods and materials described herein can be applied to a species amphibian of instead of a mammal. In some cases, the methods and materials described herein can be applied to a species of fish instead of a mammal. In some cases, a human can be administered one or more adenovirus vectors described herein and/or nucleic acid molecules that can encode an adenovirus vector described herein to increase an immune response against a pathogen (e.g., a bacterial or a viral pathogen associated with an immunogen encoded by the adenovirus vectors).

When administering adenovirus vectors described herein (e.g., adenovirus vectors encoding one or more immunogens) and/or nucleic acid molecules that can encode an adenovirus vector described herein (e.g., a composition such as a vaccine composition including adenovirus vectors described herein and/or nucleic acid molecules that can encode an adenovirus vector described herein), any appropriate route of administration can be used. For example, a composition (e.g., a vaccine composition) provided herein can be administered to a mammal (e.g., a human) orally (e.g., sublingually) or parenterally (including, without limitation, intranasally, subcutaneously, intramuscularly, intravenously, intradermally, intra-cerebrally, intrathecally, or intraperitoneally). In some cases, the route and/or mode of administration of a composition (e.g., a vaccine composition) provided herein can be adjusted for the mammal being treated. In some cases, adenovirus vectors described herein and/or nucleic acid molecules that can encode an adenovirus vector described herein can be administered to a mammal via mucosal delivery. In some cases, adenovirus vectors described herein and/or nucleic acid molecules that can encode an adenovirus vector described herein can be administered to a mammal as described elsewhere (see, e.g., Weaver et al. *PLOS ONE,* 8(7):e67574 (2013)).

Adenovirus vectors described herein (e.g., adenovirus vectors encoding one or more immunogens) and/or nucleic acid molecules that can encode an adenovirus vector described herein (e.g., a composition such as a vaccine composition including adenovirus vectors provided herein and/or nucleic acid molecules that can encode an adenovirus vector provided herein) can be administered to a mammal (e.g., a human) in any appropriate amount (e.g., any appropriate dose). Effective amounts can vary depending on the route of administration, the age and general health condition of the subject, excipient usage, the possibility of co-usage with other therapeutic treatments such as use of other agents, and the judgment of the treating physician. An effective amount of a composition containing adenovirus vectors encoding one or more immunogens (and/or nucleic acid molecules that can encode an adenovirus vector encoding one or more immunogens) can be any amount that can induce an immune response in a mammal as described herein without producing significant toxicity to the mammal. For example, an effective amount adenovirus vectors encoding one or more immunogens can be, for example, from about $10^8$ viral particles (vp) to about $10^{14}$ vp (e.g., from about $10^8$ vp to about $10^{13}$ vp, from about $10^8$ vp to about $10^{12}$ vp, from about $10^8$ vp to about $10^{11}$ vp, from about $10^8$ vp to about $10^{10}$ vp, from about $10^8$ vp to about $10^9$ vp, from about $10^9$ vp to about $10^{14}$ vp, from about $10^{10}$ vp to about $10^{14}$ vp, from about $10^{11}$ vp to about $10^{14}$ vp, from about $10^{12}$ vp to about $10^{14}$ vp, from about $10^{13}$ vp to about $10^{14}$ vp, from about $10^9$ vp to about $10^{13}$ vp, from about $10^{10}$ vp to about $10^{12}$ vp, from about $10^9$ vp to about $10^{11}$ vp, from about $10^{10}$ vp to about $10^{12}$ vp, or from about $10^1$ vp to about $10^{13}$ vp). The effective amount can remain constant or can be adjusted as a sliding scale or variable dose depending on the mammal's response to treatment. Various factors can influence the actual effective amount used for a particular application. For example, the frequency of administration, duration of treatment, use of multiple treatment agents, and/or route of administration may require an increase or decrease in the actual effective amount administered.

Adenovirus vectors provided herein (e.g., adenovirus vectors encoding one or more immunogens) and/or nucleic acid molecules that can encode an adenovirus vector provided herein (e.g., a composition such as a vaccine composition including adenovirus vectors provided herein and/or nucleic acid molecules that can encode an adenovirus vector provided herein) can be administered to a mammal (e.g., a human) in any appropriate frequency. The frequency of administration can be any frequency that can induce an immune response in a mammal without producing significant toxicity to the mammal. In some cases, adenovirus vectors provided herein and/or nucleic acid molecules that can encode an adenovirus vector provided herein can be administered to a mammal once (e.g., in a single administration). In some cases, adenovirus vectors provided herein and/or nucleic acid molecules that can encode an adenovirus vector provided herein can be administered to a mammal several times (e.g., as several administrations). For example, the frequency of administration can be from about once a day to about every three days, from about once a day to about once a week, from about once a week to about every 3 weeks, or from about once a week to about every 6 weeks. The frequency of administration can remain constant or can be variable during the duration of treatment. As with the effective amount, various factors can influence the actual frequency of administration used for a particular application. For example, the effective amount, duration of treatment, use of multiple treatment agents, and/or route of administration may require an increase or decrease in administration frequency.

Adenovirus vectors provided herein (e.g., adenovirus vectors encoding one or more immunogens) and/or nucleic acid molecules that can encode an adenovirus vector provided herein (e.g., a composition such as a vaccine composition including adenovirus vectors provided herein and/or nucleic acid molecules that can encode an adenovirus vector provided herein) can be administered to a mammal (e.g., a human) for any appropriate duration. An effective duration for administering or using a composition containing adenovirus vectors encoding one or more immunogens (and/or nucleic acid molecules that can encode an adenovirus vector encoding one or more immunogens) can be any duration that can induce an immune response in a mammal without producing significant toxicity to the mammal. For example, the effective duration can vary from a couple of days to one week, from several days to several weeks, or from a few days to a month. Multiple factors can influence the actual effective duration used for a particular treatment. For example, an effective duration can vary with the frequency of administration, effective amount, use of multiple treatment agents, and/or route of administration.

In some cases, an adenovirus vector provided herein (e.g., an adenovirus vector encoding one or more immunogens) and/or a nucleic acid molecule that can encode an adenovirus vector provided herein (e.g., a composition such as a vaccine composition including adenovirus vectors provided herein and/or nucleic acid molecules that can encode an adenovirus vector provided herein) can be administered to a mammal (e.g., a human) at an effective amount one, two, or three times with one week to four weeks between each administration when more than one administration is used.

The invention will be further described in the following examples, which do not limit the scope of the invention described in the claims.

EXAMPLES

Example 1: A Replicating Single-Cycle Adenovirus Vaccine Against *Clostridium difficile*

*Clostridium difficile* causes nearly 500,000 infections and nearly 30,000 deaths each year in the U.S. and costs up to $4.8 billion per year. *C. difficile* infection (CDI) arises from bacteria colonizing the large intestine and releasing its two toxins, Toxin A (TcdA) and Toxin B (TcdB). This example describes a SC-Ad gene-based vaccine against *C. difficile*.

Results

Single-Cycle Adenovirus Expressing *C. difficile* Toxins A and B fusion protein.

Figure 1B:
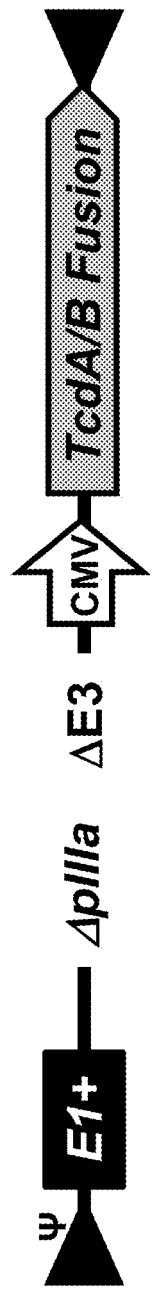
Figure 2A:
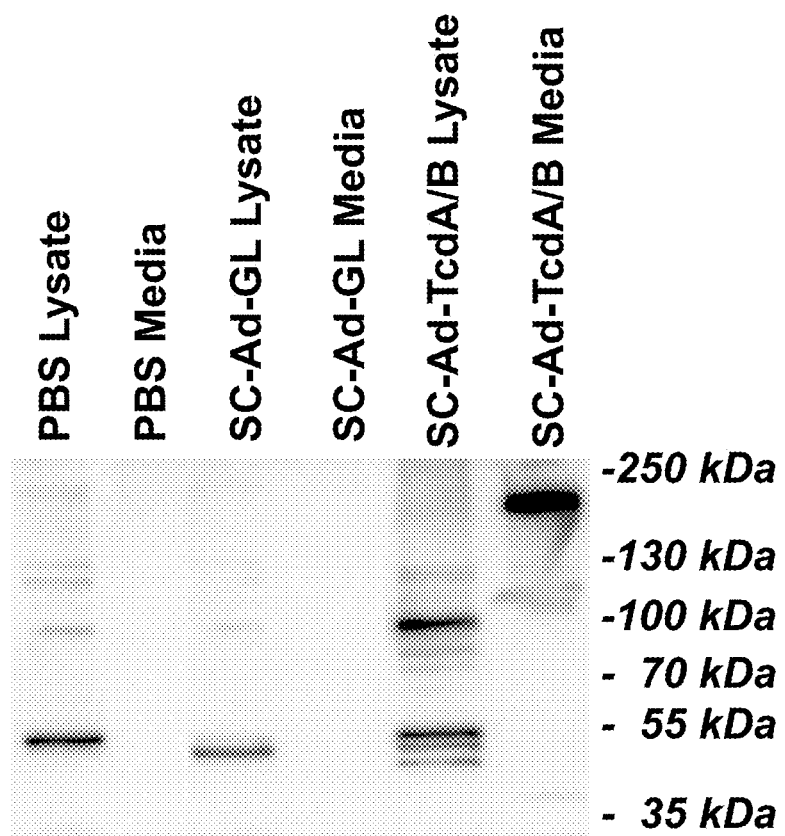
Figure 2B:
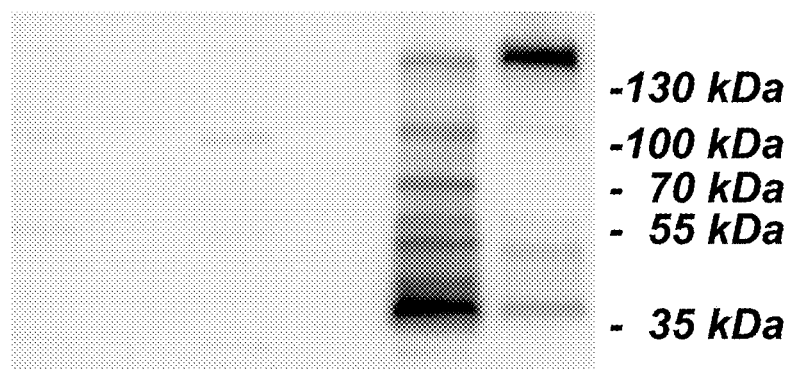

A SC-Ad-TcdA/B vector was generated using adenovirus type 6 (Ad6) (FIG. 1). This vector carries a mammalian codon-optimized cDNA that expresses a fusion protein consisting of a secretory leader and the RBDs of TcdA and B separated by two furin cleavage sites. The toxin RBDs were derived from the strain VPI 10463 (toxinotype 0) with glutamine for the asparagine substitutions in putative n-linked glycosylation sites. This resulted in a total of eight substitutions in the TcdA RBD and three alterations within the TcdB RBD sequences. Human lung A549 cells were infected with SC-Ad6-TcdA/B and cell supernatants and lysates were analyzed by western blot using antibodies specific for TcdA and TcdB. The fusion protein was predicted to be 160 kDa with the RBDs of TcdA and TcdB expected to be 100 and 60 kDa, respectively. Under these conditions, both RBDs and the fusion protein were observed in cells and in concentrated cell supernatants (FIG. 2).

Single Intramuscular Vaccination with SC-Ad6-TcdA/B Induces Immune Responses in Mice.

Figure 3A:
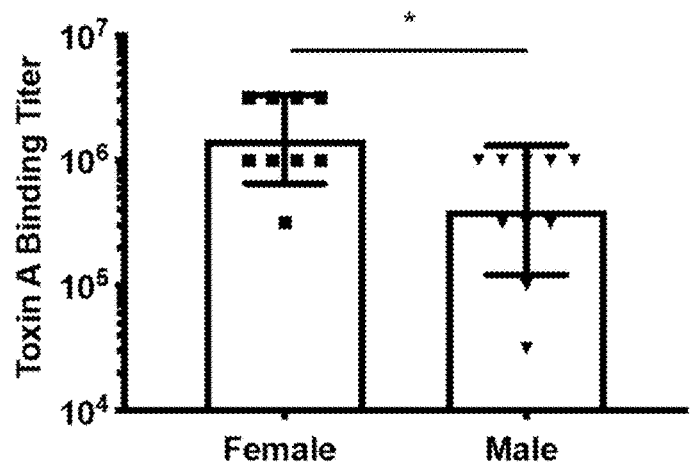
Figure 3B:
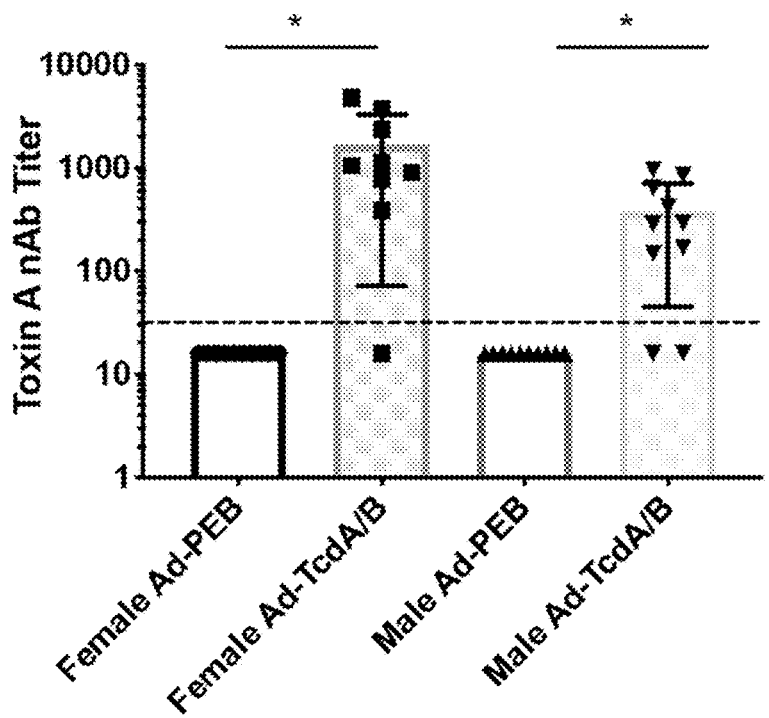
Figure 3C:
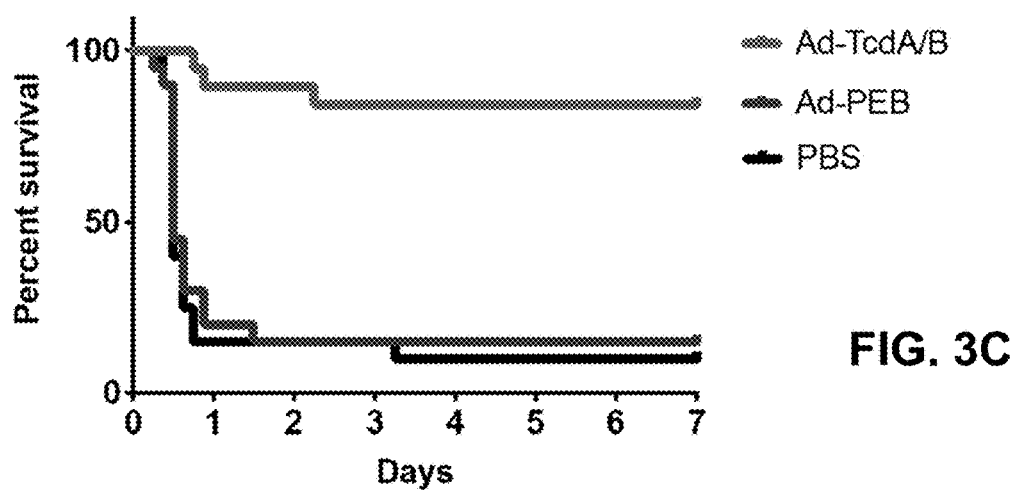

Groups of 10 male and female outbred CD-1 mice were immunized i.m. a single time with PBS or $10^{10}$ virus particles of SC-Ad6-TcdA/B or a negative control vector SC-Ad6-PEB1 that expresses a mismatched protein from another bacterium, *Campylobacter jejuni*. Serum was harvested 6 weeks after immunization and anti-toxin antibody responses were evaluated by ELISA and in vitro toxin neutralization assays. Single immunization generated significant antibodies against toxin A in the majority of the SC-Ad6-TcdA/B vaccinated animals (FIGS. 3A and 3B). Reciprocal titers were defined as those being significantly higher than levels in PBS control mice; therefore, antibody levels are not shown for the PBS group. Both animal sexes generated antibody responses that were significantly higher than in control mice. Female mice had a geometric mean reciprocal toxin A binding titer of 1,467,329 while males had titers of 397,964 (FIG. 3A). Female binding titers were significantly higher than male titers (p<0.0066 by Mann-Whitney). A similar pattern was observed in the TcdA neutralizing (nAb) titers from the two sexes, with mean titers of 1682 in females and 379 in males (FIG. 3B). However, these differences were not significant (p=0.8004 by Dunn's). When these were compared to animals immunized with SC-Ad6-PEB1, those receiving SC-Ad6-TcdA/B had nAb titers that were significantly higher than their sex matched controls.

Single Intramuscular Vaccination with SC-Ad6-TcdA/B Provides Protection Against Toxin Challenge.

8 weeks after single immunization, the mice were challenged with 300 ng (6×LD50) of purified TcdA from List Labs. The recombinant toxin was derived from a Ribotype 087 and Toxinotype 0 strain similar to VPI 10463 antigens in the SC-Ad vaccine. Eight out of ten PBS and PEB1 mice succumbed to the toxin within 24 hours of challenge (FIG.

3C). One additional PBS mouse met sacrifice criteria 3 days later. Seventeen out of the twenty SC-Ad6-TcdA/B vaccinated mice survived the challenge. Log-rank comparison of the Kaplan-Meier survival curves demonstrated that SC-Ad6-TcdA/B vaccinated animals survived significantly better than PBS or PEB1 control animals. The three SC-Ad6-TcdA/B vaccinated mice that did not survive had reduced TcdA binding titers and a complete absence of nAbs (FIGS. 3A and 3B).

SC-Ad6-TcdA/B Provides Protection Against Toxin Challenge 38 Weeks after Single Immunization.

Figure 4A:
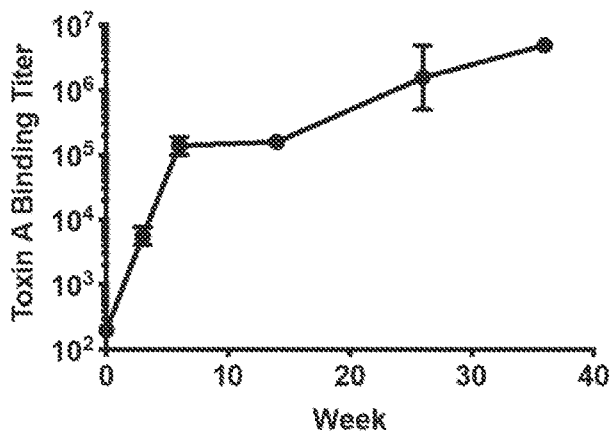
Figure 4B:
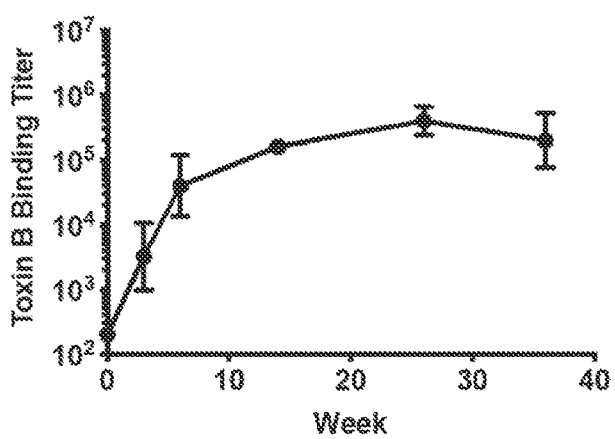
Figure 4C:
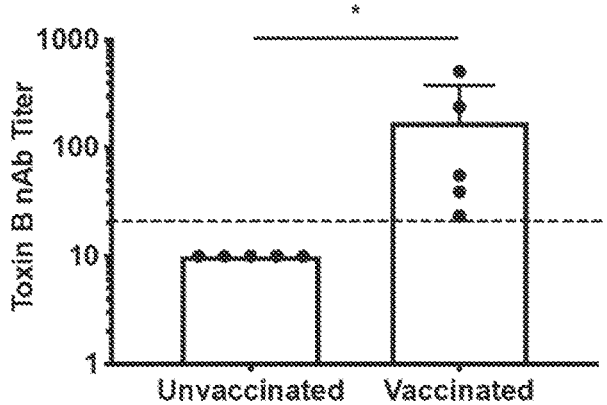
Figure 4D:
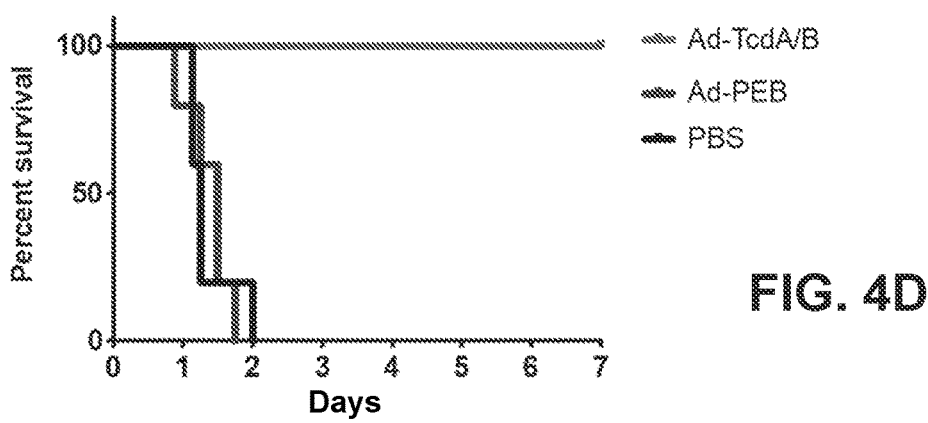

A second set of female CD1 mice were immunized i.m. a single time with $10^{10}$ virus particles of SC-Ad6-TcdA/B, SC-Ad6-PEB1, or PBS (n=5 per group). This single vaccination of SC-Ad6-TcdA/B generated strong antibody responses with reciprocal endpoint binding titers for TcdA and TcdB that climbed above 100,000 over 26 weeks (FIGS. 4A and 4B). At week 26, the average reciprocal TcdB nAb titer in the SC-Ad-TcdA/B group reached 174 (FIG. 4C). At week 38, the mice were challenged with 300 ng (6×LD50) of TcdA. All PBS and control SC-Ad-PEB1 vaccinated animals succumbed to the toxin within 48 hours (FIG. 4D). In contrast, all animals in the SC-Ad *C. difficile* vaccine group survived.

Pilot Toxicology and Efficacy Testing in Hamsters.

Figure 7:
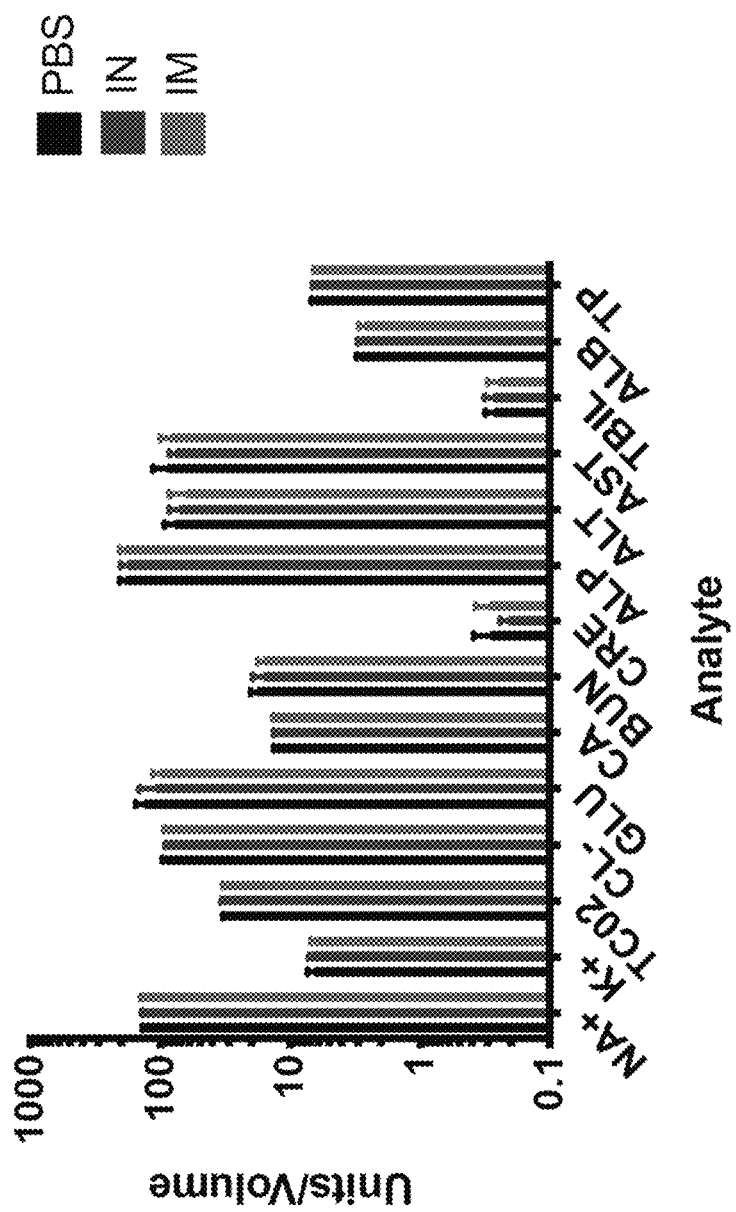

Groups of 10 Syrian hamsters were immunized a single time with $10^{11}$ virus particles of SC-Ad6-TcdA/B by the i.n. or i.m. route. Control animals received i.n. PBS. Blood was collected 3 days after immunization for clinical chemistry. These revealed no significant differences in blood chemistry (FIG. 7).

Single Intranasal or Intramuscular Vaccination with SC-Ad6-TcdA/B Induces Immune Responses in Hamsters.

Figure 5A:
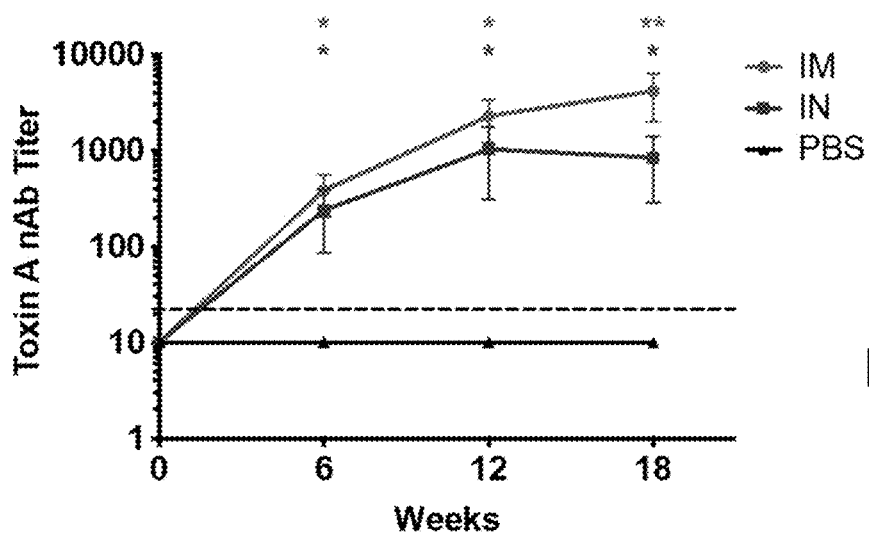
Figure 5B:
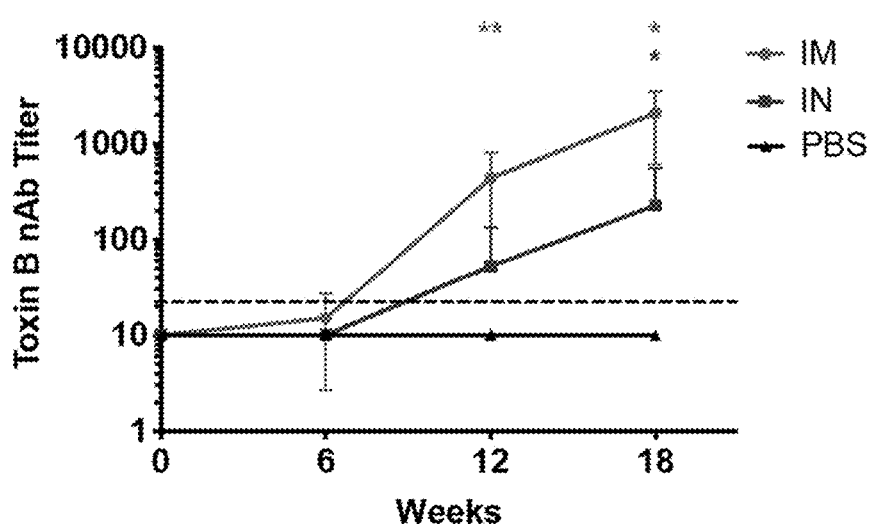

Serum was collected from the hamsters 6, 12, and 18 weeks after immunization and anti-toxin antibody responses were evaluated. Single immunization with SC-Ad6-TcdA/B generated significant serum nAbs against toxin A regardless of route. These antibody levels increased over the course of the study (FIG. 5A). While i.m. immunization produced higher mean nAbs against toxin A than the i.n. group, these were not significantly different until week 18 (p=0.0336 by Dunn's). Toxin B antibodies were detectable by ELISA at week 6. However, significant levels of nAbs against toxin B took longer to develop (FIG. 5B). All i.m. immunized animals and 6/10 of the i.n. immunized animals had significant toxin B nAb levels by week 12. At week 18, all i.m. and i.n. immunized animals had significant toxin B nAbs with mean reciprocal titers of 2084 and 229, respectively.

Single Intramuscular Vaccination with SC-Ad6-TcdA/B Provides Protection Against *C. difficile* Spore Challenge in Hamsters.

Figure 5C:
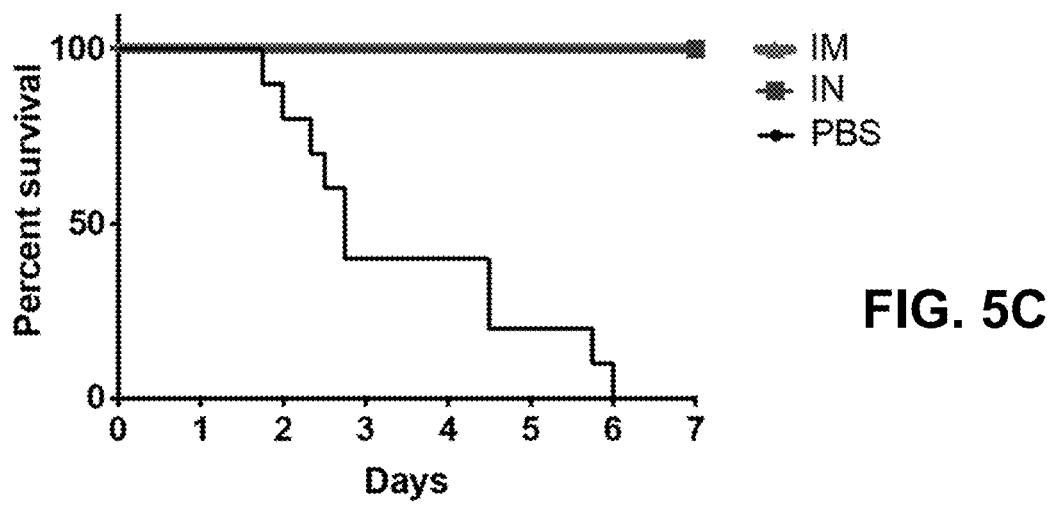

CDI can be induced in Syrian hamsters when sensitized with clindamycin. This model mimics the fecal-oral route of transmission by delivering purified *C. difficile* spores orogastrically producing symptoms similar to those observed in patients with CDI. Various toxin isoforms have been identified within clinical isolates of *C. difficile*. Recent studies report that the BI/NAP1/027 strain of *C. difficile* is the most prevalent cause of CDI in North America. Given its clinical relevance and expression of heterologous toxin isoforms, vaccine efficacy was tested using spores from the UK1 (BI/NAP1/027) strain. Hamsters were administered clindamycin intraperitoneally 24 hours before receiving 10,000 spores 20-21 weeks after a single immunization. All of the PBS immunized animals succumbed to the spore challenge (FIG. 5C). Strikingly, all of the SC-Ad6-TcdA/B vaccinated hamsters survived to the end of the study regardless of vaccine administration route. Log-rank comparison of the Kaplan-Meier survival curves demonstrated that both i.n. and i.m. SC-Ad6-TcdA/B vaccinated animals had significantly better survival than PBS control animals. Weight loss was observed in all animals over the course of the experiment, but weight loss in SC-Ad6-TcdA/B animals either stabilized or began to reverse by day 7.

SC-Ad6-TcdA/B Provides Protection Against Lethal Spore Challenge 45 Weeks after Single Immunization.

Figure 8A:
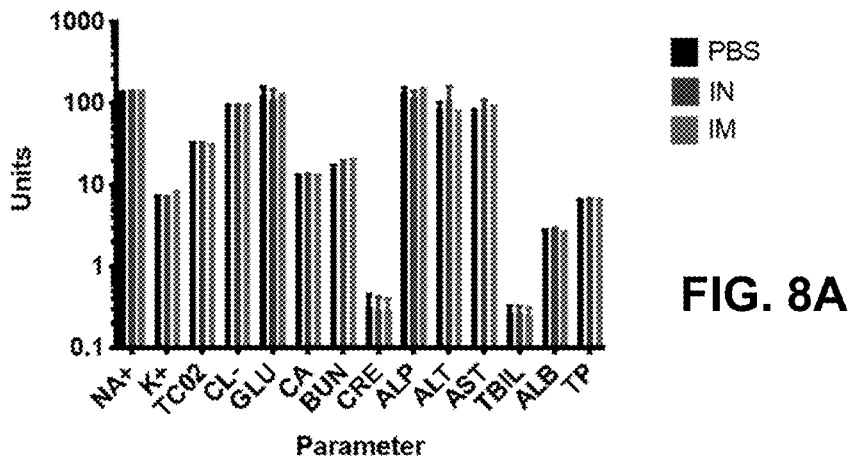
Figure 8B:
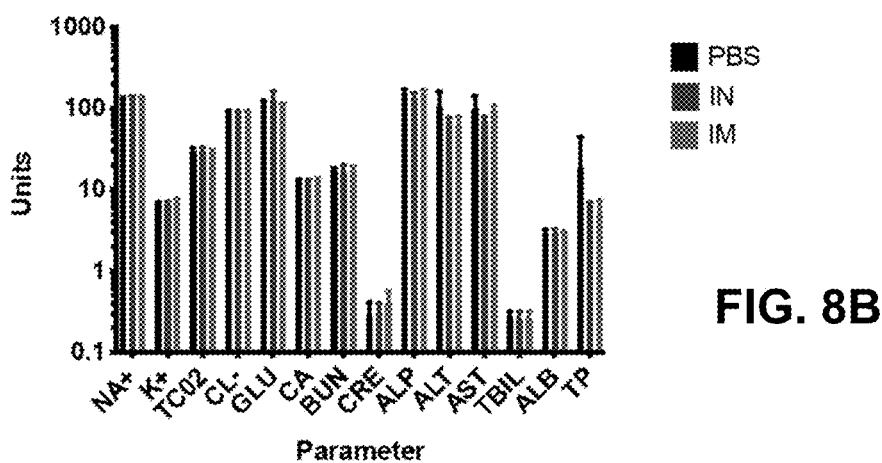
Figure 8C:
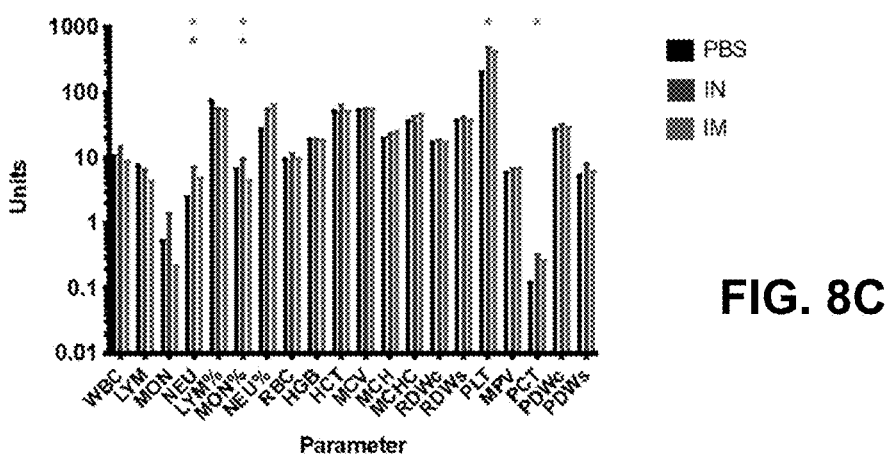
Figure 9:
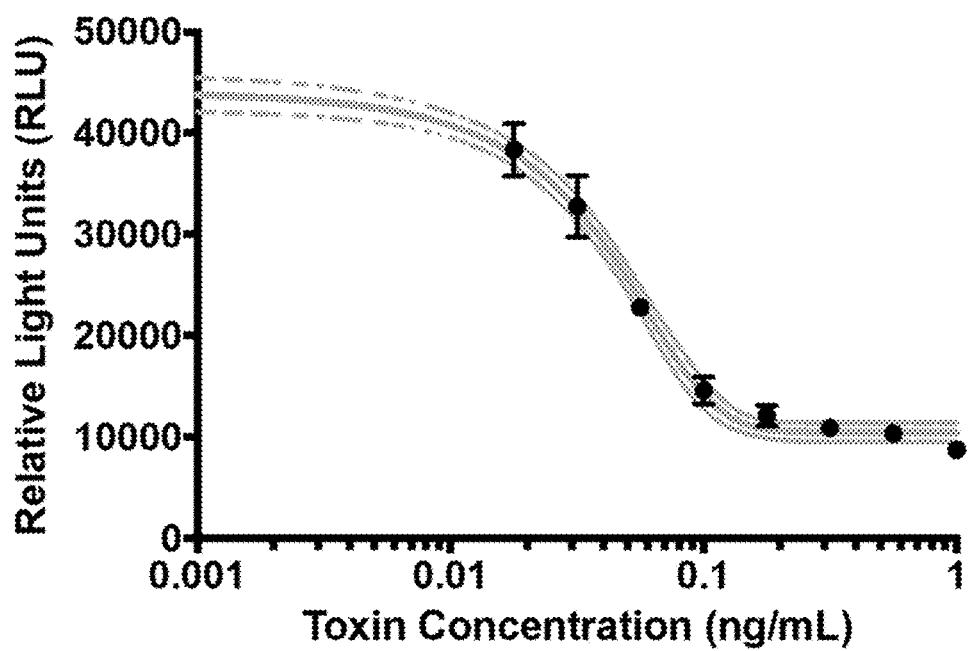
Figure 10:
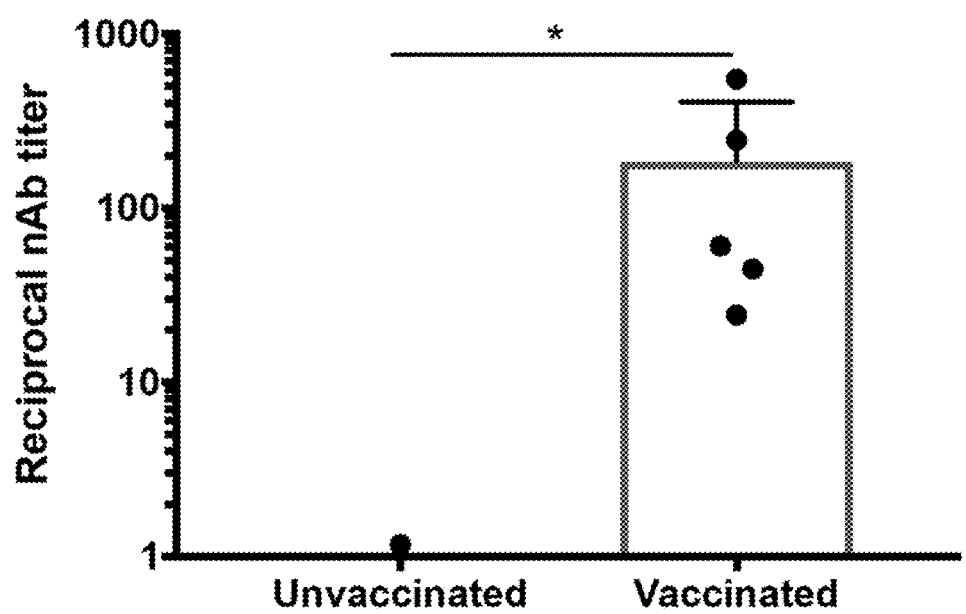
Figure 11:
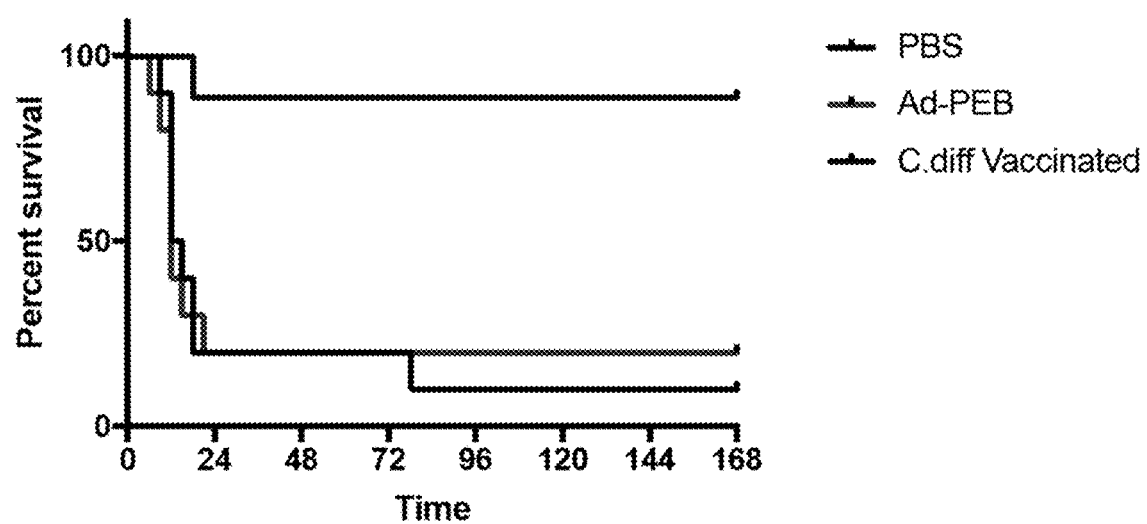

A second group of 10 female Syrian hamsters were immunized a single time with $10^{11}$ virus particles of SC-Ad6-TcdA/B either i.n. or i.m. or with PBS. Blood was collected 3 or 4 days after immunization and tested using the same analyte panel as before. Similarly, no significant differences were observed between vaccinated and unvaccinated on days 3 or 4 (FIGS. 8A and 8B). At day 4, CBCs were measured in half of the animals. There were significant increases in the percentage of neutrophils and a corresponding decrease in the percentage of lymphocytes in animals receiving vaccine compared to controls; however, comparison of the number of neutrophil and lymphocyte showed no differences (FIG. 8C). I.m. immunized animals saw increases in their platelets and plateletcrit, although these were still within normal ranges.

Figure 6A:
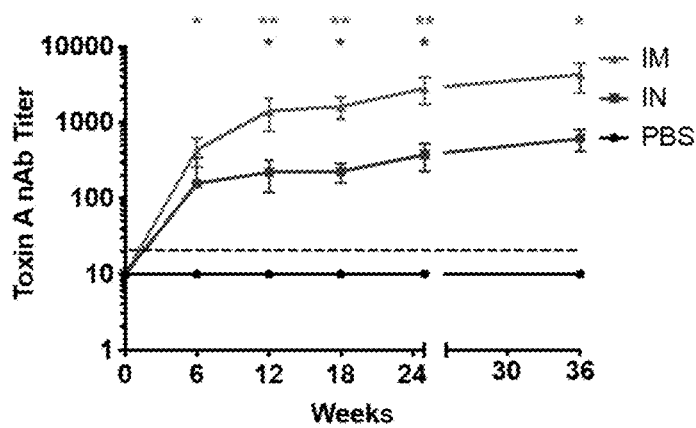
Figure 6B:
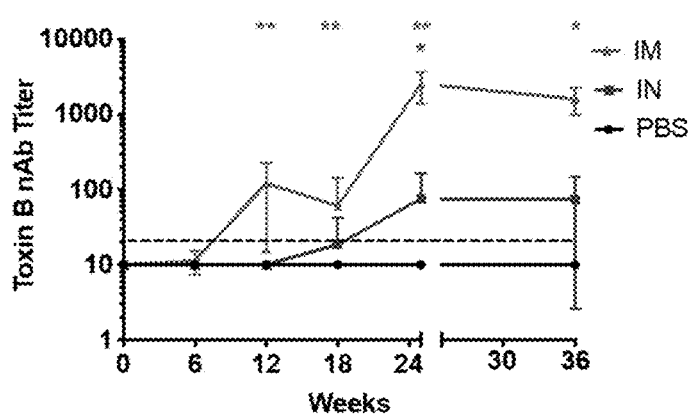

Serum collected at weeks 6, 12, and 18 showed increasing toxin A and B nAbs as in the first vaccination study (FIGS. 6A and 6B). At week 24, half of the hamsters in each group were sensitized with clindamycin given orogastrically (30 mg/kg) and then were challenged with 200 spores of *C. difficile* 5 days later. This low dose challenge surprisingly induced no symptoms or indications of *C. difficile* infection in any hamsters including the PBS controls. Serum antibodies collected at the termination of this challenge revealed no increases in toxin A or B antibodies due to the pathogen challenge compared to unchallenged animals in the cohort. The unchallenged animals were followed for an additional 20 weeks. In this period, one PBS and one i.m. immunized animals became moribund and had to be euthanized at week 42 and 44, respectively.

Figure 6C:
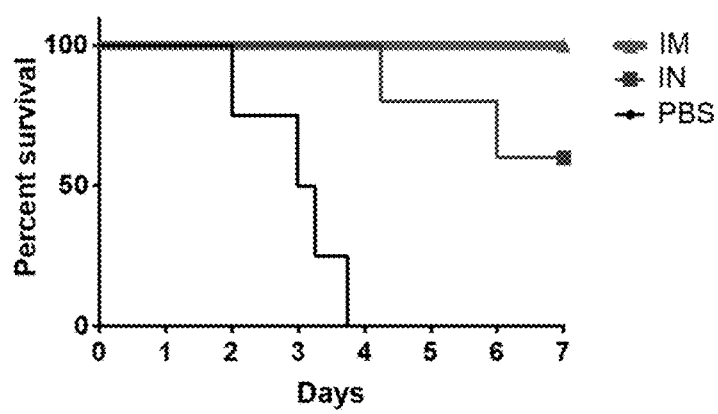
Figure 6D:
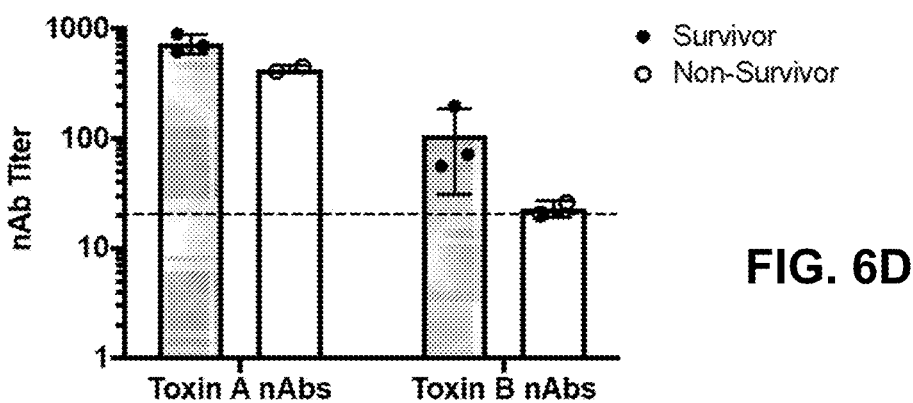

The remaining animals were challenged at week 45 using the high dose 10,000 spore challenge. All PBS immunized animals met endpoint criteria and were euthanized (FIG. 6C). Two intranasally-immunized animals also succumbed to the challenge. All animals in the i.m. vaccine group survived spore challenge. Log-rank comparison of these survival curves showed significant differences in the survival of both i.n. and i.m. SC-Ad6-TcdA/B vaccinated animals compared to PBS. Toxin nAbs levels before challenge (week 36), correlated with survival in the groups (FIG. 6D). Animals in the i.n. group that survived spore challenge had high toxin nAbs prior to challenge. In contrast, animals in this group that did not survive had lower toxin nAbs before they were challenged. Protection against *C. difficile* challenge was observed 10 months after only a single immunization with SC-Ad vaccine.

Materials and Methods

Cell Culture

A549 cells and Vero cells were purchased from the American Type Culture Collection. The 293-IIIA cells were generated as described elsewhere (Crosby et al., *Virology* 462-463:158-165 (2014)). All cells were maintained at 37° C. in Dulbecco's Modified Eagle Medium (DMEM) supplemented with 10% heat inactivated fetal bovine serum (HI-FBS; HyClone) and penicillin/streptomycin at 100 U/mL (Invitrogen).

Single-Cycle Adenovirus Expressing *C. difficile* TcdA/B Fusion

A codon-optimized cDNA encoding a novel fusion of the receptor binding domains of *C. difficile* toxins A and B was synthesized by Genscript. This cDNA contains the secretory leader sequence from alpha-1 antitrypsin (AAT) to facilitate secretion of the fusion protein. The receptor binding domains are separated by two furin cleavage sites to liberate the two Tcds from each other during secretion from mammalian cells. This cDNA was inserted into the shuttle plasmids pAd6-NdePfl and was recombined into SC-Ad6 as described elsewhere (Crosby et al., *Virology* 462-463:158-165 (2014), Crosby et al., *J. Virol.* 91(2):e00720-16 (2017); and Crosby et al., J. Virol. 89:669-675 (2015)) to generate SC-Ad6-*C. diff.* Control SC-Ad6 viruses expressing GFP-Luciferase or *Campylobacter jejuni* PEB1 were also used. Viruses were rescued, amplified, and purified as described elsewhere (Crosby et al., *Virology* 462-463:158-165 (2014), Crosby et al., *J. Virol.* 91(2):e00720-16 (2017); and Crosby et al., *J. Virol.* 89:669-675 (2015)). Virus comparisons were based on virus particles.

Western Blotting

A549 cells were infected with SC-Ad6-TcdA/B or SC-Ad-GL, which expresses GFP-Luciferase, with $10^4$ virus particles/cell. 24 hours after infection, the media was replaced with serum-free DMEM. 24 hours later, this media was collected and concentrated using Amicon Ultra-15 30 k (Millipore). The cells were harvested using Triton-X lysis buffer supplemented with Complete™ Protease Inhibitor Cocktail (Roche). Media concentrates and cell lysates were analyzed by western blot using antibodies against *C. difficile* toxin A or B (1:1000; List Biological Labs, Inc.) followed by a goat anti-chicken horseradish peroxidase secondary antibody (1:1000; Invitrogen). SuperSignal West Dura (Thermo Scientific) was added and blots were imaged on an In Vivo F Station (KODAK).

Animals

Male and female outbred CD-1 mice (Charles River Laboratories) and female Golden Syrian hamsters (Envigo) were housed in the Mayo Clinic Animal Facility. All animal handling and experiments were carried out according to the provisions of the Animal Welfare Act, PHS Animal Welfare Policy, the principles of the NIH Guide for the Care and Use of Laboratory Animals, and the policies and procedures of the Institutional Animal Care and Use Committee at Mayo Clinic.

Immunizations and Sample Collection

Mice were anesthetized with isoflurane and immunized by the intramuscular (i.m.) route with $10^{10}$ vp of the indicated vaccine. Hamsters were anesthetized with isoflurane and immunized intramuscularly (i.m.) or intranasally (i.n.) routes with $10^{11}$ vp of the vaccine. In mice, serum was collected from the facial vein at the indicated time points. At various time points, hamsters were anesthetized and blood was collected from the jugular vein.

Enzyme-Linked Immunosorbent Assay (ELISA)

Immulon 4 HBX plates (Thermo) were coated with 100 ng/well of either *C. difficile* A or B toxoids (List Biological Labs, Inc.) in 1× phosphate-buffered saline (PBS) overnight. Wells were washed and blocked with 5% milk in Tris-buffered saline with 0.1% Tween 20 (TBST) at room temperature (RT) for 2 hours. After washing with TBST, half log dilutions of each serum sample were plated in triplicate and incubated for 3 hours at RT. Wells were washed and 100 μL of 1:10,000 goat anti-mouse IgG-horseradish peroxidase (Thermo Fisher Scientific Inc.) was added to each well. Plates were incubated for 2 hours at RT. Wells were washed and 50 μL of 1 step Ultra TMB ELISA (Thermo Fisher Scientific Inc.) were added to each well. When color developed, 50 μL of 2M H2504 were added. OD450 was determined with a BioTek Synergy H1 Hybrid Multi-Mode Reader. Reciprocal titers were statistically defined based on 95% confidence interval.

Cytotoxicity and Neutralization Assays

Cytotoxicity of *C. difficile* toxin A and toxin B were determined on Vero cells using the method described elsewhere (Donald et al., *Microbiology* 159:1254-1266 (2013)). Vero cells were used in place of IMR-90 as they have similar sensitivity to Toxin B compared to IMR-90 cells, but have an increased sensitivity to toxin A. Vero cells were plated at $10^4$ cells per well in a 96 well plate. *C. difficile* toxin A or toxin B (List Biological Laboratories, Inc) was serially diluted in DMEM supplemented with 10% HI-FBS and added to cells 24 hours after plating. Three days later, cell viability was determined using the bioluminescent CellTiter-Glo reagent (Promega). An EC50 was determined to be equivalent to the amount of toxin causing 50% reduction in luminescence by fitting the data with a four-parameter equation. Toxin neutralization was determined using serial dilutions of mouse or hamster serum mixed with eight times the EC50 value determined in the cytotoxicity assay. The mixtures were incubated at 37° C. for 90 minutes in a humidified incubator (5% $CO_2$) before being added to Vero cells on 96 well-plates. Three days later, cell viability was determined with Celltiter-Glo. A four-parameter regression response was fitted to the luciferase relative light units (RLU) values derived from the serum dilutions. Neutralizing antibody (nAb) titers were expressed as the derived sample dilution that exhibited a 50% reduction in cytotoxicity. If a serum titration failed to generate 50% inhibition within the range of concentrations tested, a titer value of ½ of the highest serum concentration tested was ascribed to it.

Challenge with Recombinant *C. difficile* Toxin A in Mice

Immunized mice were challenged intraperitoneally (i.p.) with 300 ng of *C. difficile* toxin A (List Biological Laboratories, Inc). Following toxin challenge, mice were monitored every 3 hours for the first 30 hours, followed by monitoring at 6-hour intervals for 72 hours, and then every 12 hours from day 3 through day 7 (168 hours). Mice were monitored for clinical signs. Briefly, animals' symptoms were scored as normal, lethargic, abnormal or moribund. Moribund animals were euthanized immediately and recorded. The survival rate was determined for each treatment group.

Hematology and Clinical Chemistry in Hamsters

Blood was collected for clinical chemistry analysis (200 μL into lithium heparin tubes; Greiner Bio-One) and for complete blood count (CBC, 100 μl in $K_2$ EDTA tubes; Greiner Bio-One). Blood chemistry was analyzed with a Piccolo Xpress Analyzer (Abaxis) and CBCs were determined with VetScan HM5 hematology analyzer (Abaxis). Analyte parameters for the two tests are shown in Table 1 and Table 2.

TABLE 1

Veterinary Hematology Parameters Measured on the Abaxis VetScan HM5 Analyzer Results Table.

| Parameter | Abbreviation | Units |
|---|---|---|
| Sodium | NA+ | mmol/L |
| Potassium | K+ | mmol/L |
| Total Carbon Dioxide | tCO2 | mmol/L |
| Chloride | CL− | mmol/L |
| Glucose | GLU | mg/dL |

TABLE 1-continued Veterinary Hematology Parameters Measured on
the Abaxis VetScan HM5 Analyzer Results Table.

| Parameter | Abbreviation | Units |
|---|---|---|
| Calcium | CA | mg/dL |
| Blood Urea Nitrogen | BUN | mg/dL |
| Creatinine | CRE | mg/dL |
| Alkaline Phosphatase | ALP | U/L |
| Alanine Aminotransferase | ALT | U/L |
| Aspartate Aminotransferase | AST | U/L |
| Total Bilirubin | TBIL | mg/dL |
| Albumin | ALB | g/dL |
| Total Protein | TP | g/dL |

TABLE 2

Blood Chemistry Parameters Measured on the
Piccolo Xpress Chemistry Analyzer.

| Parameter | Abbreviation | Units |
|---|---|---|
| Total White Blood Cell count | WBC | 10^9L |
| Lymphocyte count | LYM | 10^9L |
| Monocyte count | MON | 10^9L |
| Neutrophil count | NEU | 10^9L |
| Eosinophil count | EOS | 10^9L |
| Basophil count | BAS | 10^9L |
| Lymphocyte percentage | LYM% | % |
| Monocyte percentage | MON% | % |
| Neutrophil percentage | NEU% | % |
| Eosinophil percentage | EOS% | % |
| Basophil percentage | BAS% | % |
| Red Blood Cell count | RBC | 10^12L |
| Hemoglobin | HGB | g/dL |
| Hematocrit percentage | HCT | % |
| Mean CorpuscularVolume | MCV | fL |
| Mean Corpuscular Hemoglobin | MCH | pg |
| Mean Corpuscular Hemoglobin Concentration | MCHC | g/dl |
| Red Cell Distribution Width, coefficient of variation % | RDWc | % |
| Red Cell Distribution Width | RDWs | fL |
| Platelet count | PLT | 10^9L |
| Mean Platelet Volume | MPV | fL |
| Platelet crit % | PCT | % |
| Platelet Distribution Width, coefficient of variation % | PDWc | % |
| Platelet Distribution Width | PDWs | fL |

Challenge with *C. difficile* Spores in Hamsters

Prior to challenge, hamsters were housed individually in ventilated cages. In the low dose challenge, hamsters were sensitized for infection using a clindamycin phosphate (Sigma-Aldrich) antibiotic solution (30 mg/kg of body weight) delivered orogastrically via a feeding needle. Five days later, the hamsters were challenged orogastrically with 200 spores from *C. difficile* strain UK1. Since low dose spore challenge did not induce symptoms in hamsters in our hands, a high dose challenge with modified clindamycin administration was used. In this challenge, hamsters were sensitized with clindamycin phosphate antibiotic solution (10 mg/kg of body weight) by the intraperitoneal route rather than the orogastric route. The hamsters were then challenged 24 hours later orogastrically with $10^4$ UK1 spores. In both the high and low dose challenge, the hamsters were monitored 4 times per day following infection by assessing them individually in a microbiological safety cabinet for several parameters, including presence and severity of wet tail, loose feces, diarrhea, weight loss, activity level, starey coat, sunken eyes, hunched posture and response to stimulus. A scoring system, based on severity of changes observed (ranging from 0-3 for each parameter), was used to quantify the condition of the animals. Animals were euthanized and considered to have succumbed to disease when they either reached a score were moribund, or suffered weight loss in excess of 20%.

Statistical Analysis

Prism 8 Graphical software was used for all statistical analyses.

Example 2: Single-Cycle Adenovirus Vectors Expressing a SARS-CoV-2 Polypeptide

Figures 12A, 12B:
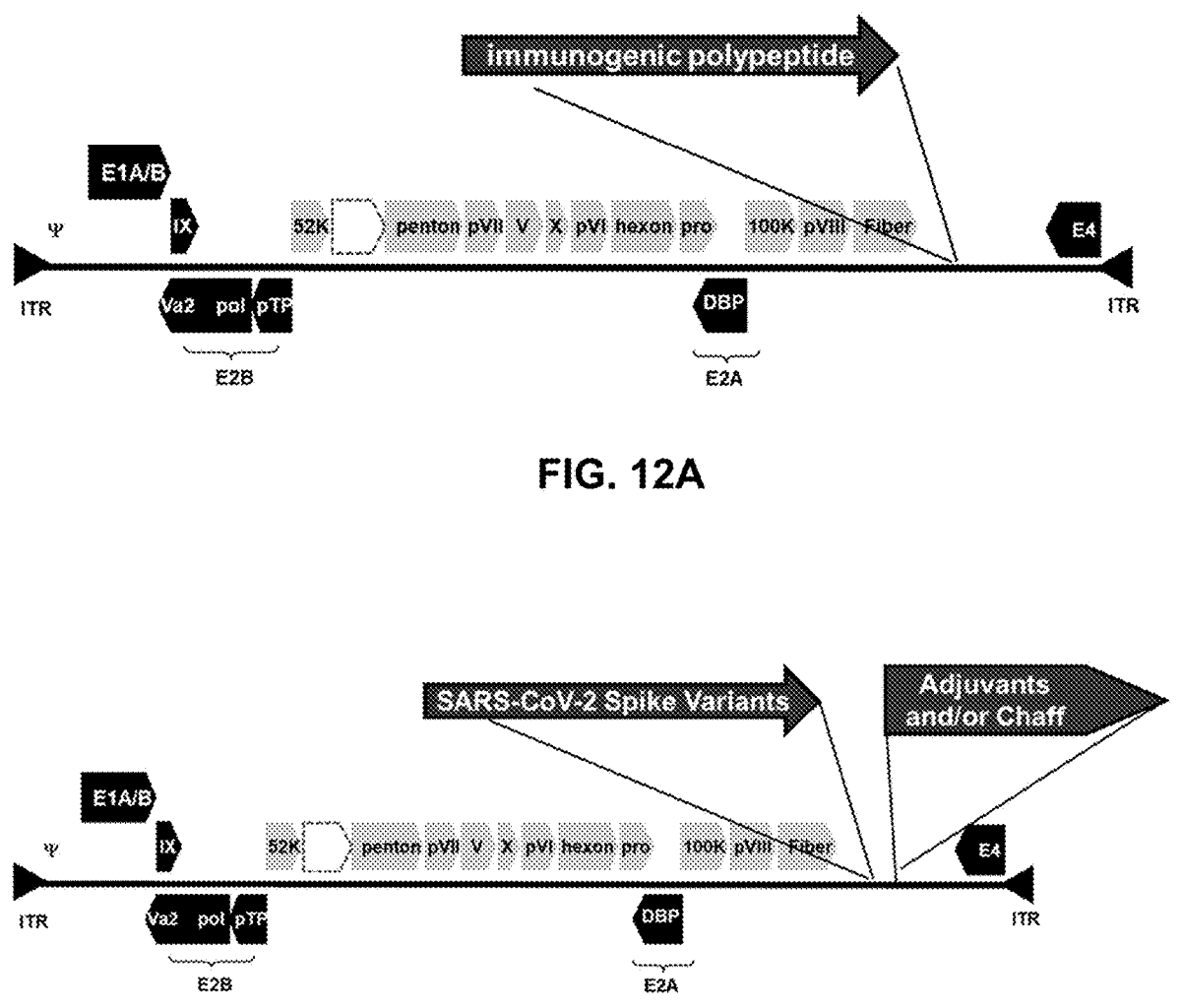
Figure 13:
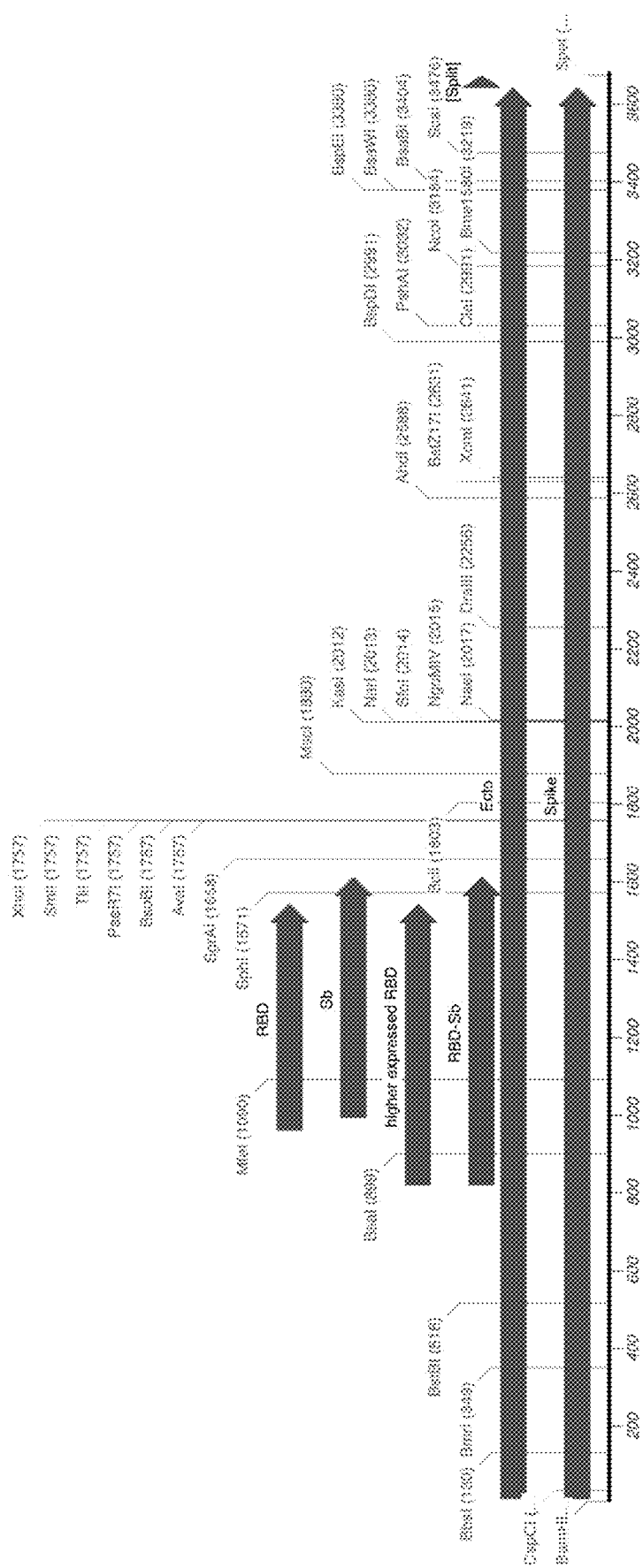
FIG. 13. SARS-CoV-2 Spike gene and RBD-Sb subdomain genes with restriction sites.
Figure 14:
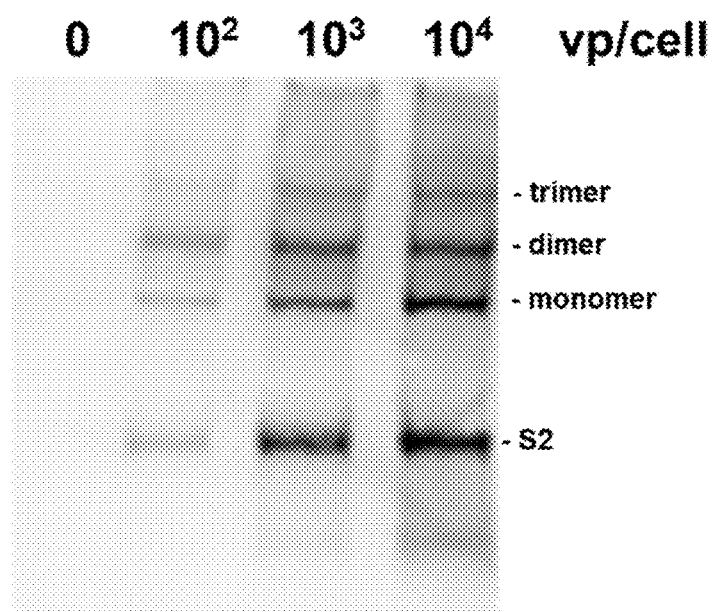
FIG. 14. Western blot of Spike polypeptide expressed by SC-Ad vector. 1°=anti-spike polyclonal (1:1000); 2°=protein A/G-HRP (1:10,000); Substrate=Pico.
Figure 16:
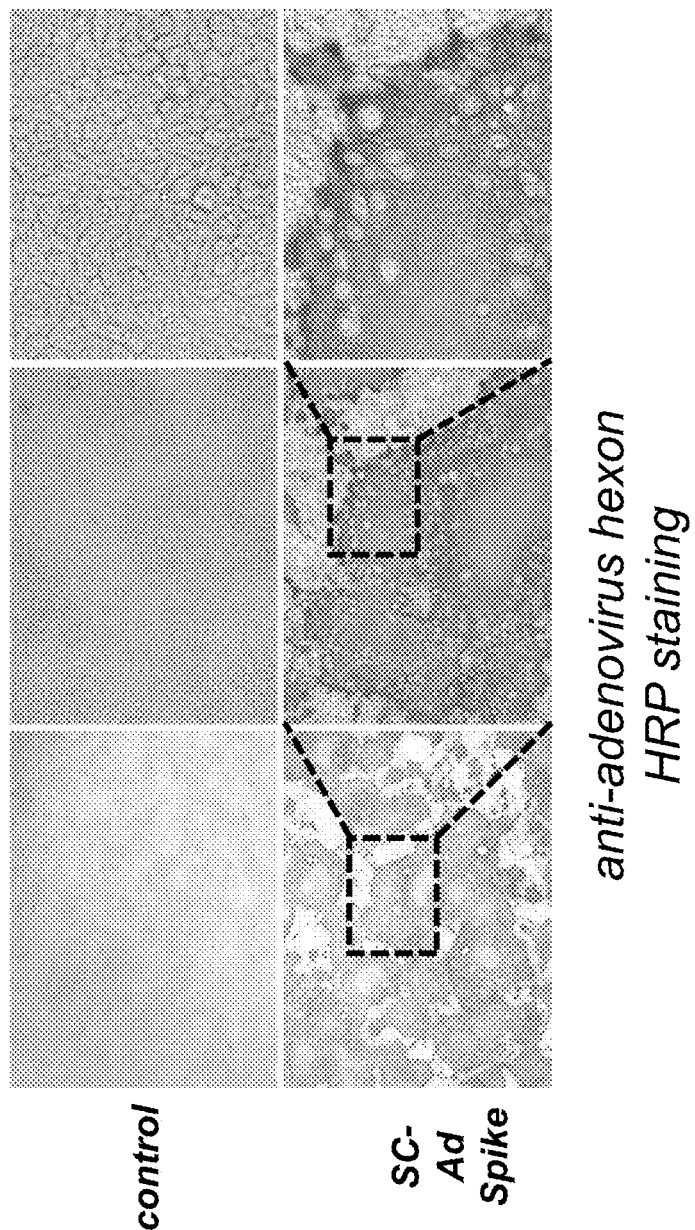
FIG. 16. SC-Ad-Spike infects ACE2+ cells, forms cell fusion events, and expresses adenovirus DNA and adenovirus protein adjuvants.
Figure 17:
FIG. 17. Western blot of ACE2 expression in 293-IIIA-ACE2 cells. 1°=anti-ACE2 (1:1000); 2°=protein A/G-HRP (1:10,000).
Figure 18:
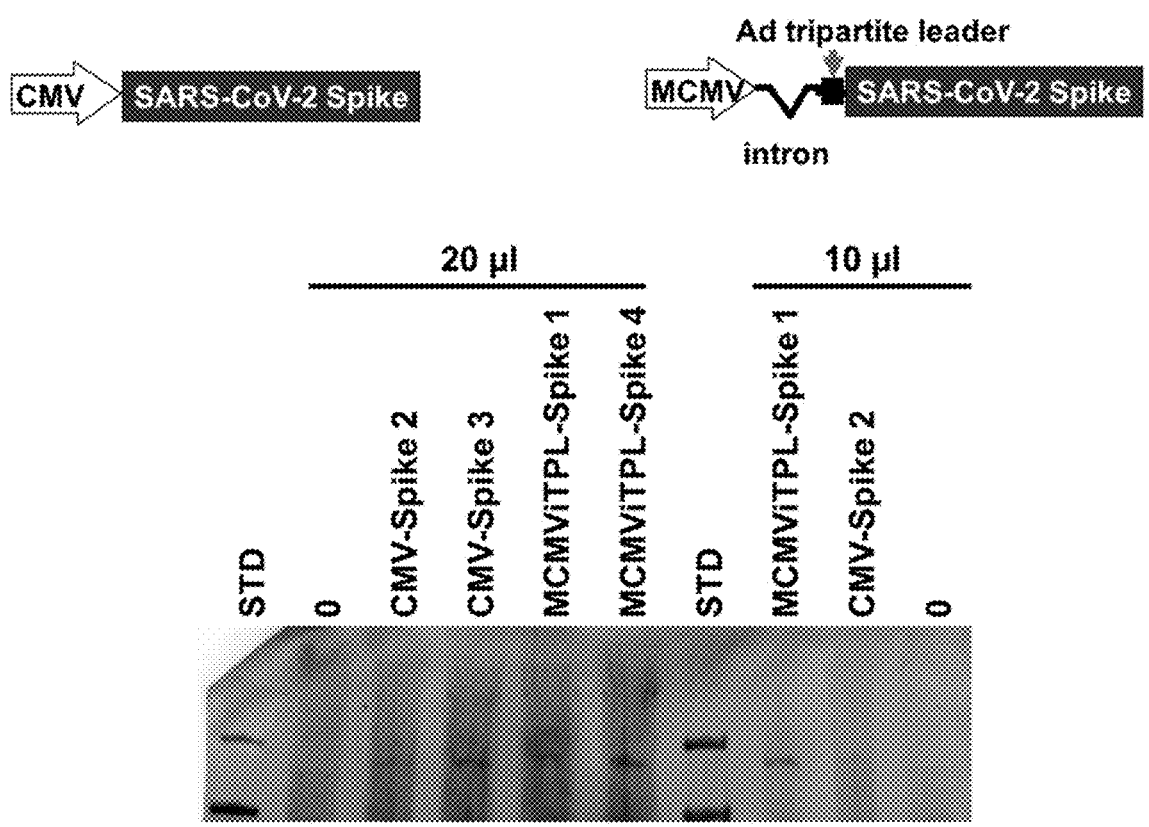
FIG. 18. Western blot of Spike polypeptide expressed by various plasmid expression vectors.
Figure 19:
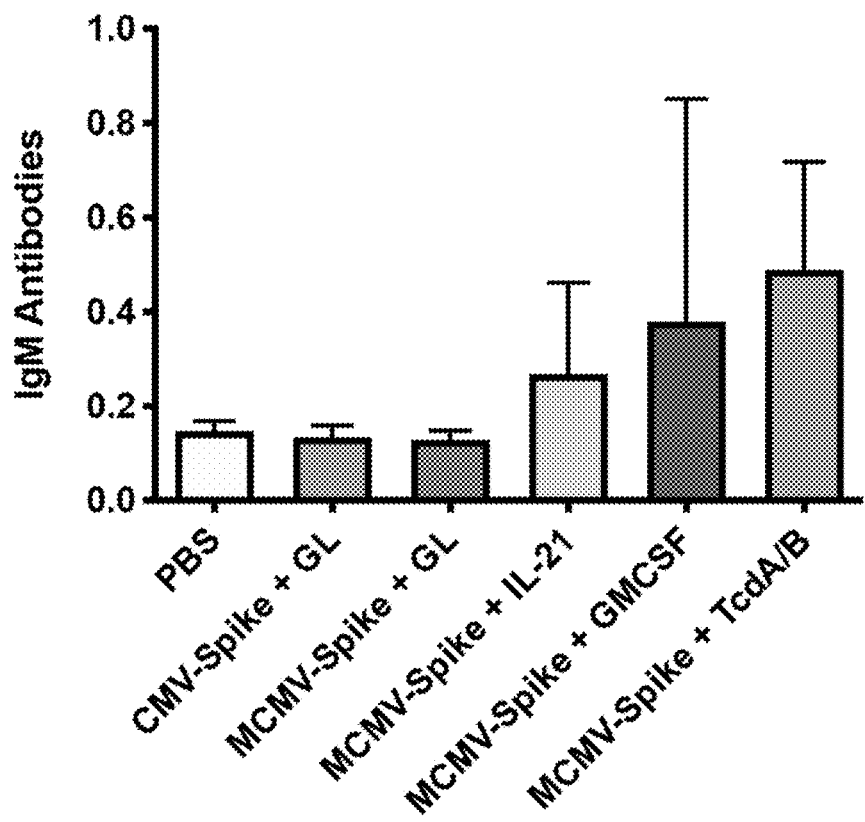
FIG. 19. Antibody responses in mice 2 weeks after administration of plasmid vectors expressing Spike polypeptide or negative control GFP-Luciferase (GL) vector.
Figure 20A:
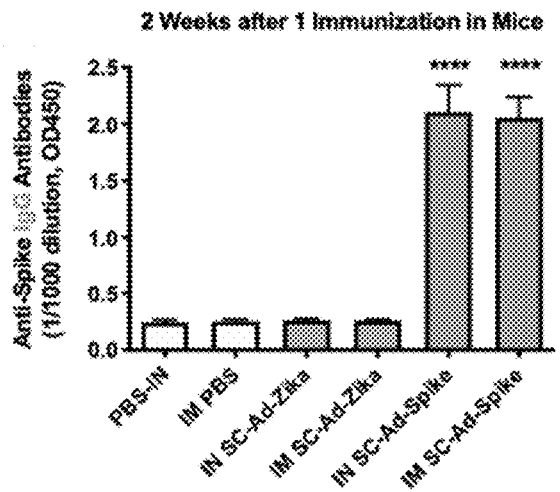
FIGS. 20A-20F. IgA and IgG antibody responses in mice 2 (FIGS. 20A, 20C, and 20D) or 6 weeks (FIG. 20B) after intranasal (IN) or intramuscular (IM) administration of SC-Ad expressing Spike polypeptide or negative control SC-Ad expressing Zika protein or buffer (PBS). IFNγ (FIG. 20E) and CD8 T cell counts (FIG. 20F) were also measured.
Figure 20B:
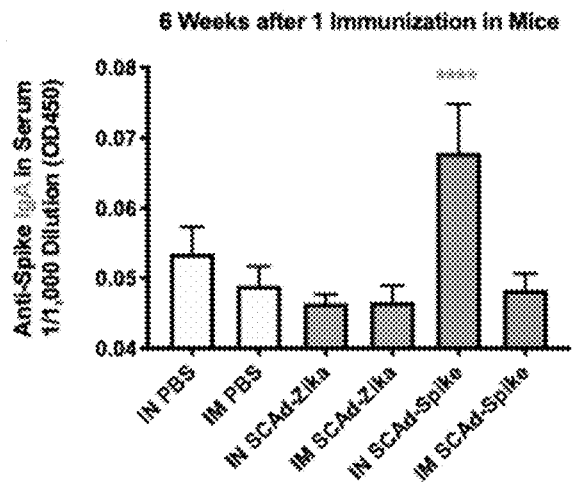
Figure 20C:
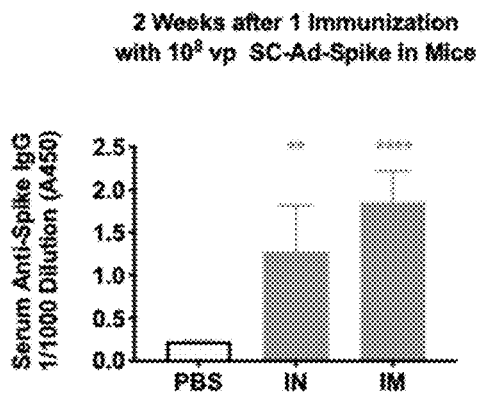
Figure 20D:
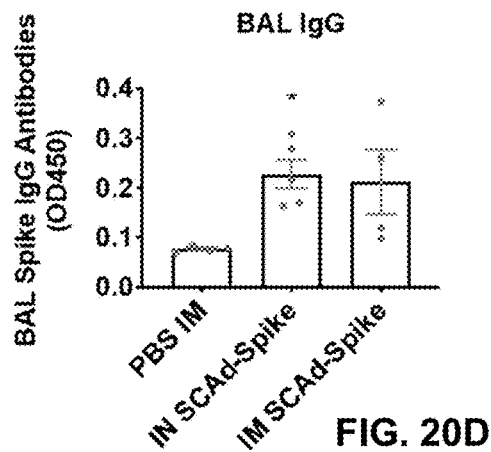
Figure 20E:
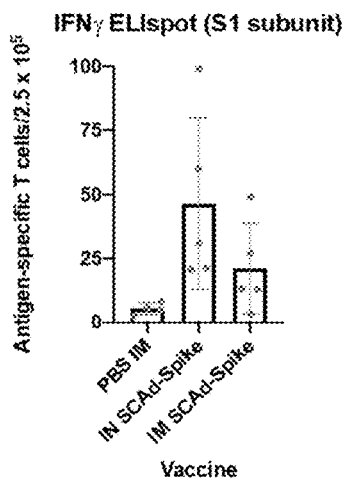
Figure 20F:
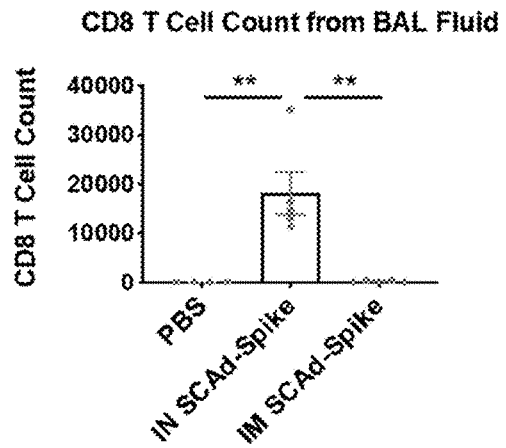

A full-length codon-optimized SARS-CoV-2 Spike cDNA (FIG. 13) or RBD-Sb subdomains were inserted into pAd6-ΔIII-ΔE3 with and without genetic adjuvant or chaff genes (FIG. 12) and rescued in 293-IIIA cells. CsCl-purified SC-Ad6-Spike produced monomer, dimer, and trimers of spike as well as cleaves S2 domain after infection of A549 human lung cells as demonstrated by western blot with anti-spike antibody (FIG. 14). SC-Ad6-Spike induced cell-cell fusion and syncytia in cells engineered to express its receptor ACE2 (FIG. 15). When these syncytia were examined, they contained abundant amounts of adenovirus proteins as demonstrated by immunohistochemical staining for adenovirus hexon with AdenoX Rapid Titer reagent (FIG. 16). When SC-Ad6-Spike was used to immunize BALB/c mice by the intranasal (i.n.) or intramuscular (i.m.) route, the virus induced strong spike antibodies within 2 weeks as demonstrated by ELISA using 1/1000 dilutions of mouse sera (FIG. 20A). These were class-switched IgG antibodies and they were significantly higher than negative control mice immunized with PBS buffer or SC-Ad expressing Zika E ($p<0.0001$ by one-way ANOVA). At 6 weeks after immunization, IgG antibodies remained elevated in sera. Notably, intranasal immunization also generated IgA antibodies indicative of responses at mucosal barriers (FIG. 20B). Dose-finding studies in BALB/c mice demonstrated significant IgG antibodies responses were generated 2 weeks after a single i.n. or i.m. immunization with $10^8$ viral particles of SC-Ad-Spike ( $p<0.01$, ** $p<0.0001$ by ANOVA, FIG. 20C).

Figure 21:
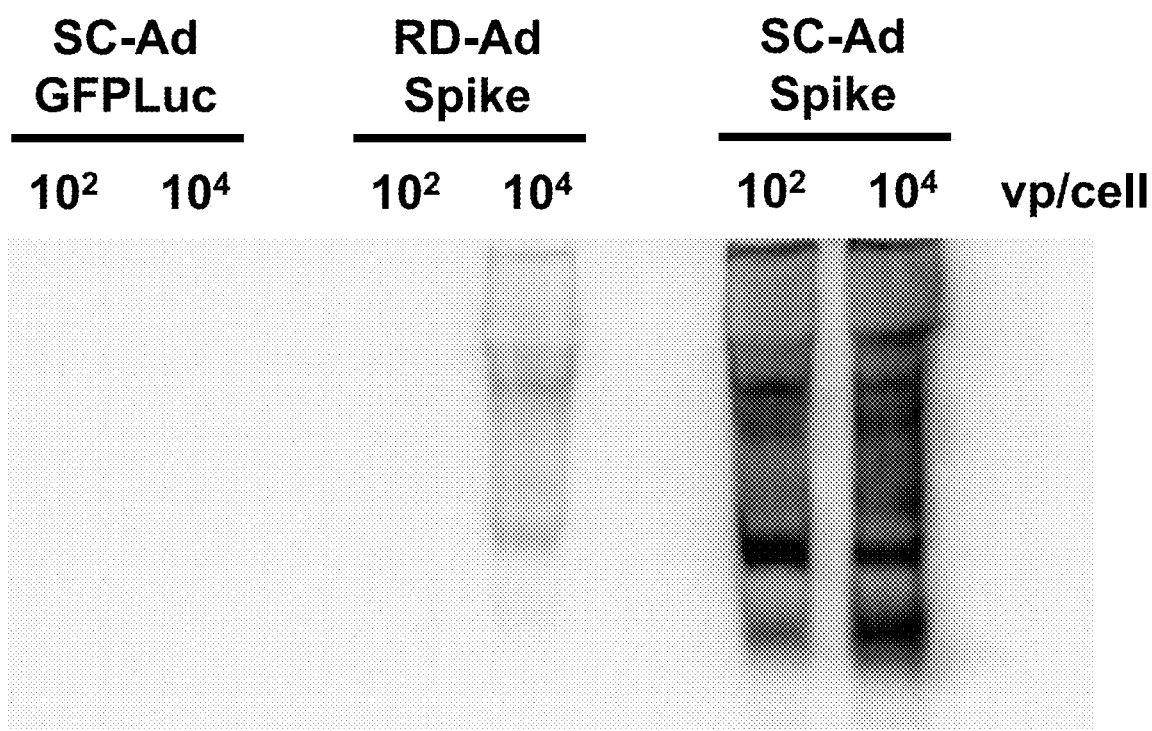
FIG. 21. Western blot of Spike polypeptide expression by replication-defective adenovirus (RD-Ad) and SC-Ad expressing SARS-CoV-2 spike.

A replication-defective Ad6 (RD-Ad6) with an E1 deletion was constructed with the same Spike expression cassette. RD-Ad6-Spike and SC-Ad-Spike were used to infect A549 human lung cells with different numbers of virus particles (vp) per cell. When cell lystates were examined 24 hours later by western blot for the Spike protein, this revealed that SC-Ad expressed high levels of Spike protein when $10^2$ or $10^4$ vp of the virus (FIG. 21). In contrast, RD-Ad-Spike produce no detectable Spike protein with $10^2$ particles of virus and only low levels of Spike protein with $10^4$ vp of virus.

Figure 22:
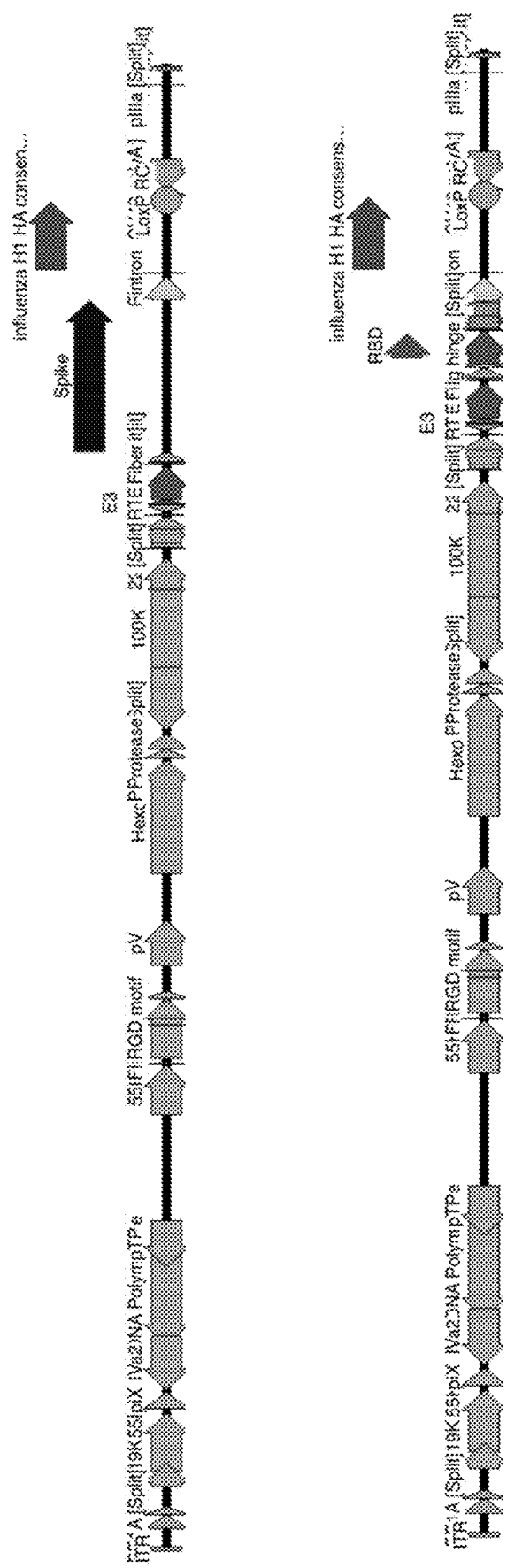
FIG. 22. An exemplary SC-Ad carrying SARS-CoV-2 Spike or RBD with centralized influenza HA gene H1-CON.
Figure 24:
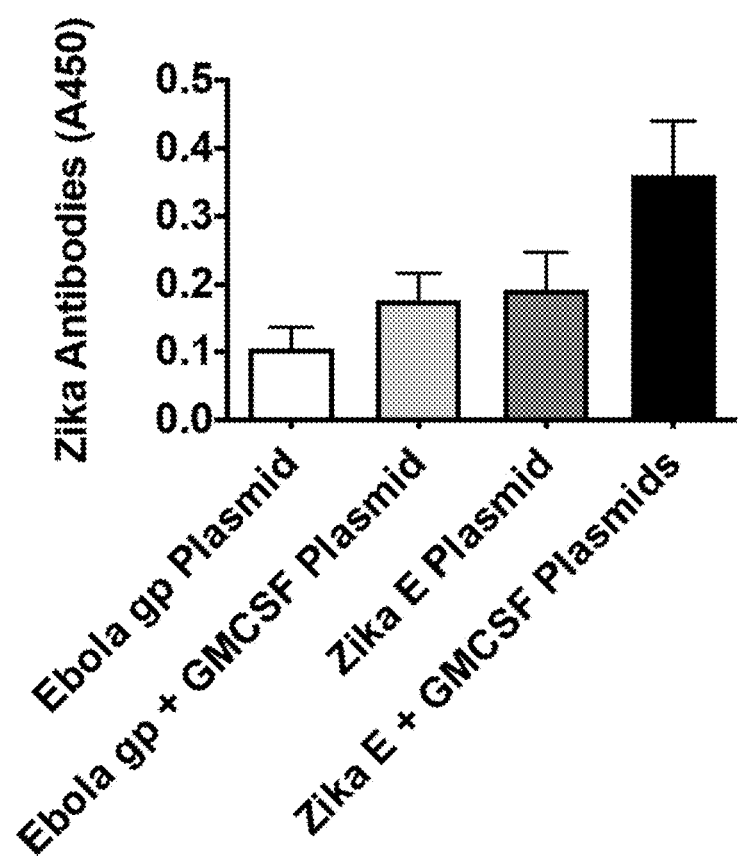
FIG. 24. Serum antibodies generated by plasmid vaccines are increased by co-immunization with granulocyte-macrophage colony-stimulating factor (GM-CSF) adjuvant plasmid.

SC-Ad expressing coronavirus Spike or RBD proteins can be modified by the addition of influenza genes to generate a combined coronavirus and influenza virus vaccine. For example, SC-Ad6 containing Spike and a centralized H1 consensus influenza hemagglutinin (H1-CON) gene or SC-Ad6 containing the Spike RBD domain and a centralized H1 consensus influenza hemagglutinin (H1-CON) gene (FIG. 22). Alternatively, an SC-Ad expressing Spike or RBD could be co-immunized with an SC-Ad expressing two influenza consensus immunogens. For example, SC-Ad6 containing centralized H1 consensus influenza H1-CON and H1-5 centralized HA gene H1-5-CON (FIG. 23).

Figure 25:
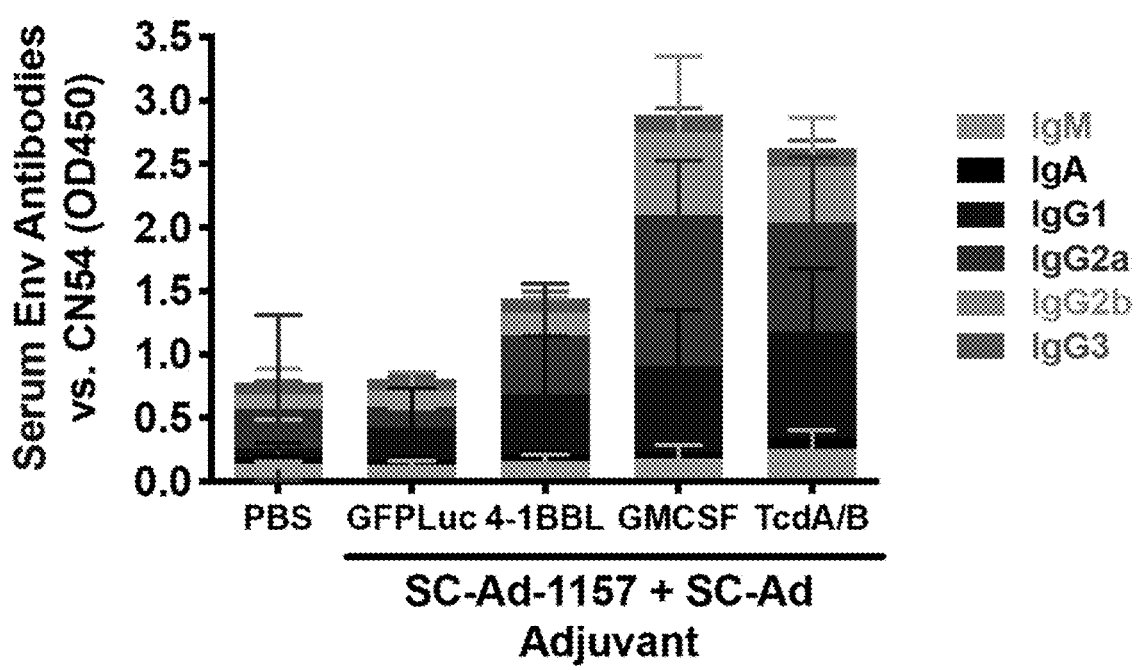
FIG. 25. Serum antibodies 6 weeks after a single i.n. administration of SC-Ad HIV Env in combination with SC-Ads expressing genetic adjuvants.
Figure 26:
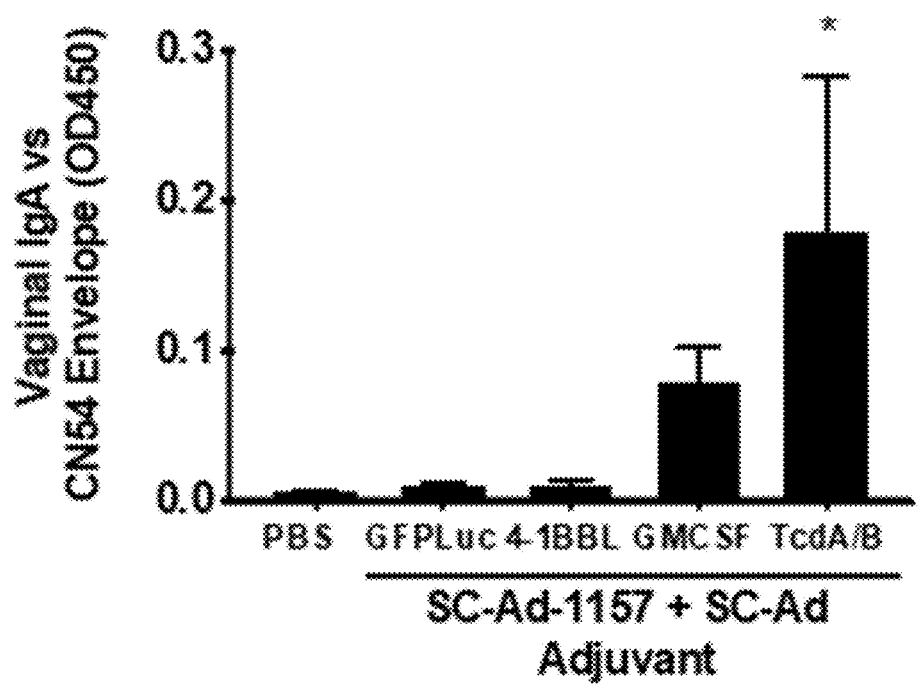
FIG. 26. Vaginal antibodies 6 weeks after a single i.n. administration of SC-Ad HIV Env in combination with SC-Ads expressing genetic adjuvants.

Example 3: Single-Cycle Adenovirus Vectors Expressing Genetic Adjuvants $10^9$ viral particles (vp) of SC-Ad6 expressing Glade C gp140 from SHIV-1157ipd3N4 was used to immunize BALB/c mice by the i.n. route in combination with 10⁹ SC-Ads expressing 4-1BBL, GMCSF, *C. diff* toxin fragment TcdA/B or a non-specific adenovirus control expressing GFP-Luciferase. ELISAs using serum collected 6 weeks after single immunization demonstrated significant increases in antibody isotypes by GMCSF and TcdA/B ($p<0.05$ or less for all IgGs) (FIG. 25). When vaginal washes were assayed for IgA at the same time point, this revealed similar trends with highest mucosal IgA mediated by i.n. co-delivery of TcdA/B adjuvant (FIG. 26).

Figure 27:
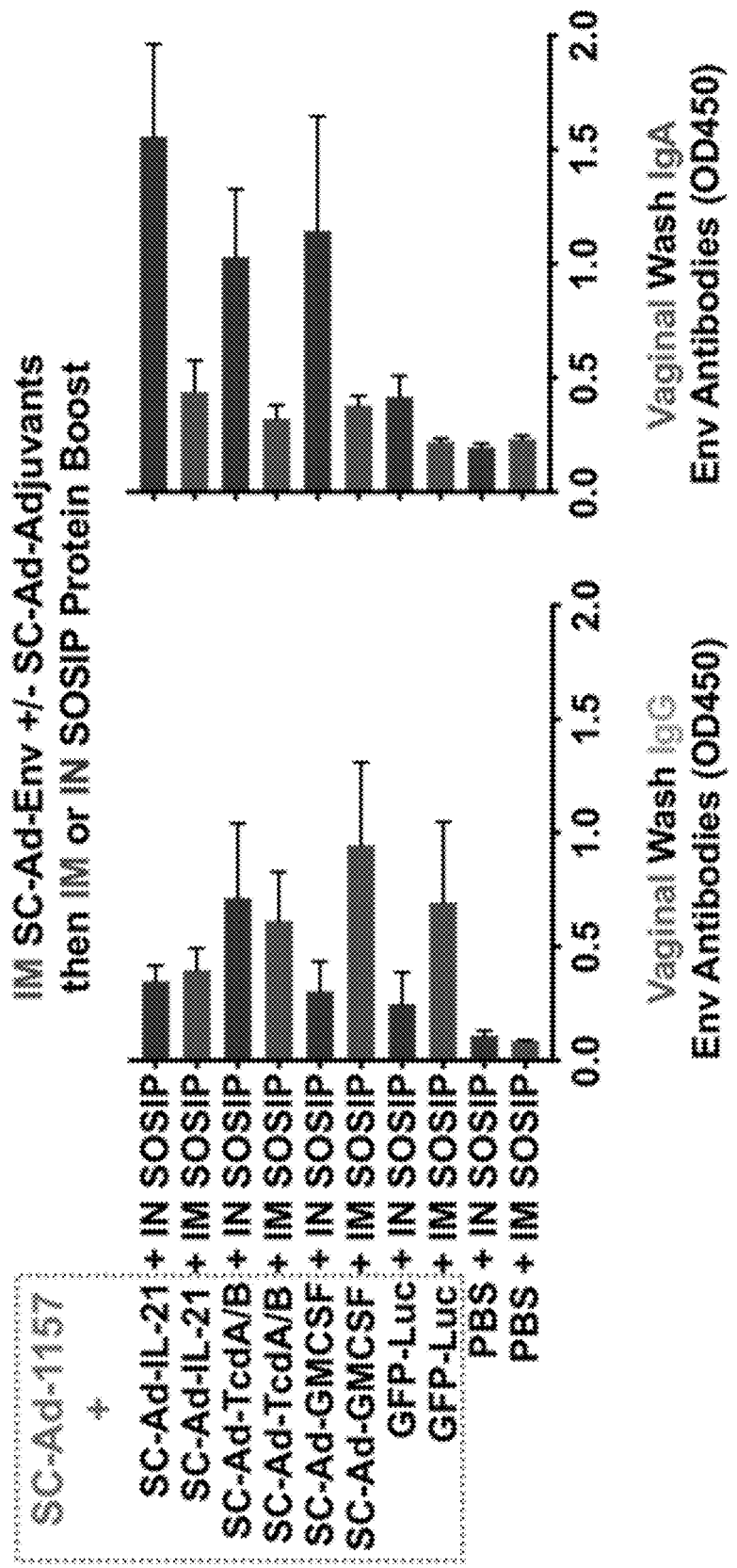
FIG. 27. Vaginal antibodies after an i.m. administration of SC-Ad HIV Env in combination with SC-Ads expressing genetic adjuvants and followed by i.m. or i.n. administration of HIV-1 Envelope SOSIP polypeptide.

SC-Ad-GMCSF and TcdA/B were tested again by the i.m. route with 10-fold more SC-Ad. SC-Ad-IL-21 adjuvant was also added for its ability to stimulate Tfh and other T cells. In this case, i.m. injections were administered to the quadriceps muscles near to the vaginal sample site. 6 weeks after this single higher dose i.m. immunization, ELISA with 1/2000 dilutions of sera showed increased env IgG levels by SC-Ad-GMCSF, TcdA/B and IL-21 ($p<0.05$ vs PBS). SC-Ad-IL-21 provided even higher antibody levels than GMCSF or TcdA/B ($p<0.0001$ vs PBS). When vaginal wash samples were tested for IgG, all SC-Ad-1157 animals had increases, but only SC-Ad-IL-21 adjuvant reached significance ($p<0.05$ vs PBS). When vaginal washes were assayed for IgA at the same time point, this revealed similar trends with higher mucosal IgA in most animals in the GMCSF, TcdA/B, and IL-21 groups, only the IL-21 group reached $p<0.05$). Soluble HIV SOSIP envelope protein was used to boost the responses generated by SC-Ad. Each of the i.m. SC-Ad-1157+SC-Ad adjuvant immunized mice was boosted with 5 µg of Glade C CZA97 SOSIP.v4.2-M6.IT mixed with the NKT cell adjuvant alphaGalCer. One half of the mice were boosted by the i.m. route and one half were boosted by the i.n. route. 2 weeks later, vaginal washes were collected and assayed for IgA or IgG antibodies against Glade C env (FIG. 27). These data showed a strong bias in antibody responses based on the route of delivery of the SOSIP protein boost. i.m. SOSIP increased vaginal IgG levels generated by i.m. SC-Ad-1157 and SC-Ad GFP-Luc or GMCSF better than i.n. protein. In contrast, i.n. SOSIP protein boost strongly amplified vaginal IgA levels in mice that were primed by the i.m. route with SC-Ad-1157 with the strongest SC-Ad adjuvants: GMCSF, TcdA/B, and IL-21. The SC-Ad-1157+SC-Ad-GFP-Luc group showed robust IgG responses when primed and boosted intramuscularly, but failed to generate a strong IgG response when the SOSIP was given i.n. Furthermore, either of these combinations failed to generate IgA responses. This would suggest that genetic adjuvants that are given in place of SC-Ad-GFP-Luc prime the animals to drive the IgA responses we observe when they are boosted i.n. also show that priming at mucosal surfaces. The protein administered to unprimed animals generated little IgG or IgA response in vaginal washes.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (39 sequences)

SEQ ID NO: 1 - protein, 1273 aa, Betacoronavirus SARS-CoV-2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 2 - protein, 1268 aa, Betacoronavirus SARS-CoV-2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGV

SEQ ID NO: 3 - protein, 1210 aa, Betacoronavirus SARS-CoV-2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYI

SEQ ID NO: 4 - protein, 338 aa, Betacoronavirus SARS-CoV-2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPF

SEQ ID NO: 5 - protein, 491 aa, Artificial
  polypeptide sequence of a receptor binding domain of a SARS-CoV-2 Spike polypeptide fused to an Ig polypeptide
DPLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 6 - protein, 420 aa, Artificial
  polypeptide sequence of a SARS-CoV-2 Spike polypeptide fused to a streptavidin polypeptide
DPLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLCCVECPPCPAPPVAGTMGGAAGSGAAEAGITGTWYNQLGSTFIVTAGADGALTGTYESAVGNAESRYVLTGRYESAPATDGSGTALGWTVAWKNNYRNAHSATTWSGQYVGGAEARINTQWLLTSGTTEANAWKSTLVGHDTFTKVKPSAASGS

SEQ ID NO: 7 - protein, 411 aa, Artificial
  polypeptide sequence of a SARS-CoV-2 Spike polypeptide fused to a sigma coil polypeptide
DPLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLCCVECPPCPAPPVAGSKGLESRVSALEKTSQIHSDTILRITQGLDDANKRIIALEQSRDDLVASVSDAQLAISRLESSIGALQTVVNGLDSSVTQLGARVGQLETGLAELRVDHDNLVARVDTAERNIGSLTTELSTLTLRVTSI

SEQ ID NO: 8 - protein, 740 aa, Homo sapiens
MSSSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVS

SEQ ID NO: 9 - protein, 740 aa, Artificial
  polypeptide sequence of an inactivated ectodomain of an ACE2 chaff polypeptide
MSSSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCLPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVS

SEQ ID NO: 10 - protein, 269 aa, Artificial
  polypeptide sequence of a TcdA/B fusion polypeptide
MPSSVSWGILLLAGLCCLVPVSLAEDPMPSSVSWGILLLAGLCCLVPVSLAEDPFNLVTGWQTINGKKYYFDINTGAALISYKIINGKHFYFNNDGVMQLGVFKGPDGFEYFAPANTQNNNIEGQAIVYQSKFLTLNGKKYYFDQDSKAVTGWRIINNEKYYFNPNNAIAAVGLQVIDNNKYYFNPDTAIISKGWQTVQGSRYYFDTDTAIAFNGYKTIDGKHFYFDSDCVVKIGVFSTSNGFEYFAPANTYNNNIEGQAIVYQSKFLT

SEQ ID NO: 11 - protein, 7096 aa, Betacoronavirus SARS-CoV-2 [sequence omitted]

SEQ ID NO: 12 - protein, 1262 aa, Betacoronavirus SARS-CoV-2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSE

SEQ ID NO: 13 - protein, 275 aa, Betacoronavirus SARS-CoV-2
MDLFMRIFTIGTVTLKQGEIKDATPSDFVRATATIPIQASLPFGWLIVGVALLAVFQSASKIITLKKRWQLALSKGVHFVCNLLLLFVTVYSHLLLVAAGLEAPFLYLYALVYFLQSINFVRIIMRLWLCWKCRSKNPLLYDANYFLCWHTNCYDYCIPYNSVTSSIVITSGDGTTSPISEHDYQIGGYTEKWESGVKDCVVLHSYFTSDYYQLYSTQLSTDTGVEHVTFFIYNKIVDEPEEHVQIHTIDGSSGVVNPVMEPIYDEPTTTTSVPL

SEQ ID NO: 14 - protein, 75 aa, Betacoronavirus SARS-CoV-2
MYSFVSEETGTLIVNSVLLFLAFVVFLLVTLAILTALRLCAYCCNIVNVSLVKPSFYVYSRVKNLNSSRVPDLLV

SEQ ID NO: 15 - protein, 218 aa, Betacoronavirus SARS-CoV-2
MADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIA

SEQ ID NO: 16 - protein, 44 aa, Betacoronavirus SARS-CoV-2
MFHLVDFQVTIAEILLIIMRTFKVSIWNLDYIINLIIKNLSKSL

SEQ ID NO: 17 - protein, 121 aa, Betacoronavirus SARS-CoV-2
MKIILFLALITLATCELYHYQECVRGTTVLLKEPCSSGTYEGNSPFHPLADNKFALTCFSTQFAFACPDGVKHVYQLRARSVSPKLFIRQEEVQELYSPIFLIVAAIVFITLCFTLKRKTE

SEQ ID NO: 18 - protein, 121 aa, Betacoronavirus SARS-CoV-2
MKFLVFLGIITTVAAFHQECSLQSCTQHQPYVVDDPCPIHFYSKWYIRVGARKSAPLIELCVDEAGSKSPIQYIDIGNYTVSCSPFTINCQEPKLGSLVVRCSFYEDFLEYHDVRVVLDFI

SEQ ID NO: 19 - protein, 419 aa, Betacoronavirus SARS-CoV-2
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 20 - protein, 566 aa, Influenza virus
MKAKLLVLLCAFTATDADTICIGYHANNSTDTVDTVLEKNVTVTHSVNLLEDSHNGKLCKLKGIAPLQLGKCNIAGWILGNPECESLISKRSWSYIVETPNSENGTCYPGDFADYEELREQLSSVSSFERFEIFPKESSWPNHNVTKGVTAACSHAGKSSFYRNLLWLTEKNGSYPKLSKSYVNNKEKEVLVLWGVHHPSNITDQRTLYQNENAYVSVVSSHYNRRFTPEIAKRPKVRGQAGRINYYWTLLEPGDTIIFEANGNLIAPWYAFALSRGFGSGIITSNAPMHECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 21 - protein, 562 aa, Influenza virus
MKVKLLILLCTFTATYADTICIGYHANNSTTYVDTITEDNVTVTHATELLESSHNGKLCNLPGVRPLDLGDCSIAGWLLGNPECDLLQNEEWSYIVERSNPANGWCYPGDFPDYEELRSLLASVSSFEKLEIIPEGFSWTNHTQNGGSGACKRGGKSSFFRNLNWLTKKGSTYPVLNVSYWNNDNEDKLYIWGVHHPSTDQEQTSLYQNASGYVSVSTSTSQQRIIPNIASRPTVRGQSGRISFYWTIVAPGDVIVFWSNGNLIAPRYWFKMNAGKSGIMKSDAPIGTCITKCQTPNGAINTSKPFQNVHPITIGECPKYVKSNRLKLATGLRNVPEKQTRGLFGAIAGFIEGGWQGMIDGWYGYHHQNPQGSGYAADLKSTQAAIDGITGKVNIVIEKMNTQFHAVGKEFNELECRIENLNKKVEDGFIDLWTYNAELLVLLENERTLDFHDSNVKNLYEKVRRQLRENAKEIGNGCFEFYHKCDNECMESVRNGTYDYPKYREEAKKNRFQIKGVKLKSGYKNQILWISFTTVSTLLLVVVLGGIFWCCGNGSLKCRICI

SEQ ID NO: 22 - protein, 863 aa, Clostridium difficile
FNLVTGWQTINGKKYYFDINTGAALISYKIINGKHFYFNNDGVMQLGVFKGPDGFEYFAPANTQNNNIEGQAIVYQSKFLTLNGKKYYFDQDSKAVTGWRIINNEKYYFNPNNAIAAVGLQVIDNNKYYFNPDTAIISKGWQTVQGSRYYFDTDTAIAFNGYKTIDGKHFYFDSDCVVKIGVFSTSNGFEYFAPANTYNNNIEGQAIVYQSKFLTLNGKKYYFDQNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANQESKMVTGVFKGPNGFEYFAPANTHNNNIEGQAIVYQNKFLTLNGKKYYFDQDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTQTSIASTGYTIISGKHFYFNTDGIMQIGVFKGPDGFEYFAPANTDANNIEGQAIRYQNRFLYLHDNIYYFGQNSKAATGWVTIDGNRYYFEPNTAMGANGYKTIDNKNFYFRNGLPQIGVFKGSNGFEYFAPANTDANNIEGQAIRYQNRFLHLLGKIYYFGQNSKAVTGWQTINGKVYYFMPDTAMAAAGGLFEIDGVIYFFGVDGVKAPGIYG

SEQ ID NO: 23 - protein, 516 aa, Clostridium difficile
NLITGFVTVGDDKYYFNPINGGAASIGETIIDDKNYYFQQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMEQESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESIQYTGWLDLDEKRYYFTDEYIAATGSVIIDGEEYYFDPDTAQLVISE

SEQ ID NO: 24 - DNA, 2589 bp, Clostridium difficile
tttaatctggtgacaggctggcagactatcaatgggaagaaatactatttcgacattaacaccggcgccgctctgatcagctacaagatcattaacgggaaacacttctacttcaacaatgacggagtgatgcagctgggcgtctttaagggccccgatgggttcgagtacttcgcacctgccaatacacagaacaataacattgaaggacaggccatcgtgtatcagtccaaattcctgactctgaacggcaagaaatactattttgaccaggattctaaggccgtcaccgggtggcgaatcattaataacgagaagtactacttcaaccccaataacgctattgcagccgtgggcctgcaggtcatcgacaataacaagtactatttcaaccctgatactgccatcatttccaaaggatggcagaccgtgcagggctctcgctactatttcgacaccgatacagccatcgccttcaacgggtacaagaccatcgacggaaaacatttctattttgactcagattgcgtggtcaagatcggcgtgttcagcacctccaacggcttcgagtactttgccccagctaacacatacaacaacaacatcgagggccaggccatcgtgtaccagagcaagttcctgaccctgaatggcaagaaatactacttcgaccagaactctaaggcagtcaccgggtggcagacaatcgatagtaagaagtactacttcaacactaacaccgccgaggctgcaactggctggcagaccatcgacgggaagaaatattatttcaatacaaacactgccgaagccgctacaggatggcagactattgacggcaagaaatattacttcaacaccaacacagcaatcgcctctacagggtacactatcattaatggaaagcacttctacttcaacactgatgggatcatgcagattggagtgttcaaaggaccaaatggcttcgagtactttgctcccgcaaacacagacgccaacaatattgagggccaggctatcctgtatcagaatgaattcctgacactgaacggcaagaaatattattttgggtctgatagtaaggctgtgactggctggaggatcattaacaataagaagtactatttcaaccccaacaacgcaatcgcagccattcacctgtgcaccattaacaatgacaagtactacttcagctacgacggcatcctgcagaatgggtatatcacaattgagcgcaacaatttctactttgacgccaaccaggaatccaagatggtgaccggcgtcttcaaagggcctaatggatttgaatatttcgccccagctaacacacataataacaatatcgaggggcaggctatcgtgtatcagaataagttcctgaccctgaacggcaagaaatactactttgaccaggatagcaaagccgtgaccggatggcagacaatcgatggcaagaaatattatttcaatctgaacacagccgaggccgcaactgggtggcagaccatcgatggaaagaaatactacttcaacctgaacactgctgaagccgctaccggatggcagactatcgacgggaagaaatactatttcaatactaacacctttattgcctctaccggatacacaagtatcaatggcaagcacttctacttcaacacggatggaatcatgcagattggcgtgttcaaaggccccaacggatttgaatactttgcacctgccaacactcataataacaatattgaaggccaggctatcctgtaccaaaataagttcctgaccctgaacgggaagaaatattacttcggatcagacagcaaagccgtgaccggcctgaggacaatcgatgggaagaaatattatttcaatacgaacactgctgtggcagtcactggatggcagaccattaatggcaagaaatattacttcaacacgcagacaagcatcgcctccactgggtacaccatcattagcggaaagcacttctacttcaacaccgacggcattatgcagatcggagtgttcaaaggccctgatggatttgagtactttgcccccgctaatacagatgcaaataacattgaaggccaggccatccgataccagaaccggttcctgtatctgcatgacaatatctactattttggccagaactccaaggcagccacaggctgggtgactatcgatgggaatcggtactatttcgagcctaatacagctatgggggcaaacggatacaagactatcgataacaagaacttctacttccggaatggcctgcctcagatcggggtgtttaagggcagcaacggattcgagtactttgcaccagccaacaccgacgccaataatattgaaggccaggcaatcagataccagaacaggttcctgcatctgctgggcaaaatctactacttcggccagaattccaaagcagtgactggctggcagacaatcaacggaaaggtctactacttcatgcctgacacagcaatggctgcagccggcggactgttcgagattgacggcgtgatctacttctttggagtggatggcgtcaaagcacctggaatctacgga

SEQ ID NO: 25 - DNA, 1548 bp, Clostridium difficile
aacctgatcactggattcgtgaccgtcggcgacgataagtactacttcaaccctattaacggaggcgctgcatccatcggcgagaccatcatcgacgataagaactactacttccagcagagtggggtgctgcagacaggagtcttctcaactgaggacggcttcaagtactttgctccagcaaataccctggatgaaaacctggagggagaagccattgactttacaggcaagctgatcatcgatgaaaacatctactacttcgacgataactaccgcggagctgtggagtggaaagaactggacggcgagatgcactatttctctccagaaaccggcaaggccttcaaggggctgaatcagatcggagactacaagtactatttcaacagcgatggcgtgatgcagaaggggtttgtctccatcaatgacaacaaacactacttcgacgatagcggagtgatgaaggtcggctacaccgagattgatggcaaacatttctattttgctgagaatggggaaatgcaaatcggagtgttcaacacagaagatggcttcaagtactttgcccaccataatgaggacctgggcaacgaggaaggggaggaaatttcctactctggcatcctgaacttcaacaacaaaatctactatttcgacgatagcttcaccgcagtggtgggatggaaggacctggaggatggaagcaaatactattttgacgaggataccgccgaagcttacattggcctgtccctgatcaatgacgggcagtactacttcaacgacgatggcattatgcaagtggggttcgtcaccatcaacgacaaggtgttctactttagtgattcaggaatcattgagtctggcgtccagaatattgacgataactacttctatatcgacgataatgggatcgtgcagattggagtcttcgacaccagcgatgggtacaagtattttgcacccgccaacaccgtgaatgacaacatctacggccaggccgtcgagtattcaggcctggtgcgggtcggggaagacgtgtactatttcggcgagacttacaccattgaaacagggtggatctatgacatggagcaagaaagtgataagtactatttcaatcctgagactaagaaagcctgcaaaggcatcaacctgattgacgatatcaagtactacttcgatgagaagggaatcatgagaaccggcctgatcagcttcgaaaacaataactactacttcaacgagaacggggaaatgcagttcggatacatcaacatcgaggacaagatgttctacttcggggaagatggagtgatgcagatcggagtctttaacacacccgacggcttcaaatactttgcccaccagaatactctggatgagaacttcgagggggaatctatccagtacaccggatggctggacctggatgagaagaggtactatttcaccgacgagtacatcgccgctacaggcagtgtgattatcgacggcgaggagtattacttcgatcccgacaccgctcagctggtcatctcagag

SEQ ID NO: 26 - DNA, 36201 bp, Betacoronavirus SARS-CoV-2
  misc_feature (7190)..(7190): n is a, c, g, or t
  misc_feature (21091)..(21091): n is a, c, g, or t
  misc_feature (24027)..(24027): n is a, c, g, or t
  misc_feature (34791)..(34791): n is a, c, g, or t
cgccatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccataaagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctancatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagtcgcggccgcgatatcgctagcgaagttcctattctctagaaagtataggaacttcggatcctctagagtcgaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgttatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcgccggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgggtccctgcgccgcgccgccagcggtccgcgatcgttgcggcccgtagccagtggcaactggcaaagcacactgaacagcatcgtgggtttgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagttcgcccgcgccaccgagacgtacttcagcctgaataacaagtttagaaaccccacggtggcgcctacgcacgacgtgaccacagaccggtctcagcgtttgacgctgcggttcatccccgtggaccgcgaggatactgcgtactcgtacaaggcgcggttcaccctagctgtgggtgataaccgtgtgctagacatggcttccacgtactttgacatccgcggcgtgctggacaggggccctacttttaagccctactctggcactgcctacaacgcactggcccccaagggtgcccccaactcgtgcgagtgggaacaaaatgaaactgcacaagtggatgctcaagaacttgacgaagaggagaatgaagccaatgaagctcaggcgcgagaacaggaacaagctaagaaaacccatgtatatgcccaggctccactgtccggaataaaaataactaaagaaggtctacaaataggaactgccgacgccacagtagcaggtgccggcaaagaaattttcgcagacaaaacttttcaacctgaaccacaagtaggagaatctcaatggaacgaagcggatgccacagcagctggtggaagggttcttaaaaagacaactcccatgaaaccctgctatggctcatacgctagacccaccaattccaacggcggacagggcgttatggttgaacaaaatggtaaattggaaagtcaagtcgaaatgcaatttttttccacatccacaaatgccacaaatgaagttaacaatatacaaccaacagttgtattgtacagcgaagatgtaaacatggaaactccagatactcatctttcttataaacctaaaatgggggataaaaatgccaaagtcatgcttggacaacaagcaatgccaaacagaccaaattacattgcttttagagacaattttattggtctcatgtattacaacagcacaggtaacatgggtgtccttgctggtcaggcatcgcagttgaacgctgttgtagatttgcaagacagaaacacagagctgtcctaccagcttttgcttgattcaattggcgacagaacaagatacttttcaatgtggaatcaagctgttgacagctatgatccagatgtcagaattattgagaaccatggaactgaggatgagttgccaaattattgctttcctcttggtggaattgggattactgacacttttcaagctgttaaaacaactgctgctaacggggaccaaggcaatactacctggcaaaaagattcaacatttgcagaacgcaatgaaataggggtgggaaataactttgccatggaaattaacctgaatgccaacctatggagaaatttcctttactccaatattgcgctgtacctgccagacaagctaaaatacaaccccaccaatgtggaaatatctgacaaccccaacacctacgactacatgaacaagcgagtggtggctcctgggcttgtagactgctacattaaccttggggcgcgctggtctctggactacatggacaacgttaatccctttaaccacccccgccatgcgggcctgcgttaccgctccatgttgttgggaaacggccgctacgtgccctttcacattcaggtgccccaaaagttttttgccattaaaaacctcctcctcctgccaggctcatacacatatgaatggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcanatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttntgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgacagatctgagctcgcggccgcgatatcgctagcgaagttcctattctctagaaagtataggaacttcgatcctctagagtcgacctgcaggcatgcaagcttggcactgcaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattcgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccaccatgtttgtctttctcgtgctgctgcccctcgtgagcagccagtgcgtcaatctgacaacaaggacccagctgccccccgcctacaccaactccttcacaagaggcgtgtattaccccgataaggtcttcagatccagcgtcctccacagcacccaagatttgtttctgcctttcttcagcaacgtgacatggttccacgccattcatgtcagcggcacaaacggcacaaagaggtttgacaaccccgtgctccccttcaacgacggcgtgtacttcgccagcacagagaaatccaatatcattaggggctggatcttcggcacaacactggattccaagacccagtctctgctcattgtgaataacgccaccaacgtggtgattaaggtctgtgagtttcagttctgcaacgacccctttctgggagtctactaccacaagaataataagagctggatggagtccgagtttagggtgtacagctccgccaacaactgtaccttcgaatacgtgtcccagcctttcctcatggatctggagggcaagcaaggcaatttcaaaaatctgagagagttcgtgttcaaaaacattgatggatacttcaaaatctacagcaagcatacccccattaatctggtgagggatctgccccaaggattctccgctctggaacctctggtggatctgcccattggcattaacatcacaagattccagaccctcctcgccctccatagatcctatctgacccccggcgactcctccagcggatggacagccggagctgccgcctactacgtgggctatctgcagccaagaacctttctgctgaagtacaacgagaacggcaccatcacagacgctgtcgattgcgctctcgaccctctgagcgagaccaaatgcacactgaagagcttcaccgtggaaaagggcatctatcagaccagcaacttcagagtgcagcctaccgagagcattgtgaggtttcccaacatcaccaatctgtgtcctttcggcgaggtctttaatgccacaaggttcgcttccgtgtatgcttggaataggaagaggatcagcaattgcgtcgccgactattccgtcctctataacagcgcctccttctccaccttcaaatgttatggcgtgtcccccaccaagctcaacgacctctgcttcaccaatgtgtacgctgactccttcgtcattaggggcgacgaggtgaggcaaattgcccccggccagaccggcaagattgctgattacaactacaaactgcccgacgattttaccggctgcgtgatcgcttggaactccaacaatctggactccaaagtgggcggaaactacaattacctctacagactctttagaaaaagcaatctgaagcccttcgagagagacatctccaccgaaatctaccaagccggaagcacaccttgcaatggcgtcgagggatttaactgctacttccctctgcagagctacggctttcaacctaccaacggcgtcggatatcaaccctatagggtggtcgtgctgagctttgaactgctgcatgctcccgccaccgtctgcggacctaagaagagcaccaatctcgtcaaaaacaagtgcgtgaacttcaacttcaatggactgaccggcaccggcgtgctgaccgagagcaataagaagtttctgcccttccagcagttcggaagggatattgccgataccacagatgctgtgagggacccccaaaccctcgagattctggatatcaccccttgcagcttcggaggagtgtccgtgatcacccccggaacaaacacctccaatcaagtggctgtgctgtaccaagacgtgaactgcacagaagtccccgtggccatccatgccgaccagctgacccctacatggagagtgtactccaccggcagcaatgtgttccagacaagagccggatgcctcattggagctgaacacgtcaacaacagctacgagtgcgacattcccatcggcgccggcatttgtgcctcctatcagacccagaccaacagcccaagaagggctagaagcgtcgcttcccaatccatcattgcctacaccatgtctctgggagccgaaaactccgtcgcctactccaacaatagcatcgccatccccaccaattttaccatctccgtgaccacagagattctgcccgtgtccatgacaaagacatccgtggactgcaccatgtacatctgtggcgacagcaccgagtgtagcaatctgctgctgcaatatggcagcttctgcacccagctgaacagagccctcaccggcatcgccgtcgaacaagacaagaacacccaagaggtgttcgcccaagtgaagcaaatctacaagaccccccctatcaaagatttcggaggattcaactttagccagattctgcccgatcctagcaagccttccaagaggagcttcatcgaggatctgctgtttaataaggtgacactggccgacgctggcttcattaaacagtacggcgattgtctgggcgacatcgctgctagggatctgatctgcgctcagaagttcaacggactgacagtcctccctcctctgctgaccgacgagatgatcgctcagtataccagcgctctgctggctggaaccattaccagcggctggacattcggcgctggagccgccctccaaattccctttgccatgcagatggcctatagattcaacggcattggcgtcacccaaaatgtgctgtatgaaaatcagaagctgattgctaaccaattcaatagcgccattggcaagatccaagactctctgagctccacagccagcgccctcggaaagctgcaagacgtggtgaatcaaaacgcccaagctctgaacacactggtgaaacagctcagcagcaactttggagccatcagcagcgtgctcaatgatatcctctctaggctggacaaagtggaggccgaagtccagatcgatagactcatcaccggcagactccaatctctgcagacatacgtcacccaacagctcattagagctgccgaaatcagagcctccgccaatctggccgccaccaagatgtccgagtgcgtgctgggacagagcaagagagtggacttctgtggcaagggataccatctgatgagcttcccccagagcgctccccatggagtggtctttctgcatgtcacatacgtgcccgcccaagagaagaacttcaccaccgctcccgccatttgccacgatggaaaggcccactttcccagagaaggagtgttcgtgagcaacggcacacactggtttgtcacccagagaaatttttacgagccccagattatcaccaccgacaacaccttcgtgtccggaaactgcgatgtcgtgattggcatcgtgaacaacacagtctacgaccctctgcagcccgaactcgacagcttcaaggaagagctggacaagtacttcaagaatcacacatcccccgacgtggatctgggcgacattagcggcattaatgcctccgtcgtcaacattcagaaggagattgatagactgaatgaagtcgccaagaacctcaatgagtctctgattgatctgcaagagctgggcaagtacgagcaatacatcaaatggccttggtacatctggctgggattcatcgctggactcatcgccatcgtgatggtcaccattatgctgtgttgcatgaccagctgctgcagctgtctgaagggctgctgcagctgcggaagctgctgcaagtttgacgaagacgactccgagcccgtgctgaagggcgtcaagctgcattatacataaactagtgctggaattcgcccttatagagtgctggaattcgcccttatagagtgctggaattcgcccttatatctagtaacggccgccagtgtgctggaattcgcccttataacttcgtatagcatacattatacgaagttattgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaataacttcgtatagcatacattatacgaagttataagggcgaattctgcagatatccatcctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacaacgtgtttatttttcaattgcagaaagaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcanggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacccctgaaaaaccctcctgcccctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatggcgat

SEQ ID NO: 27 - DNA, 36579 bp, Artificial
  nucleic acid sequence encoding a TcdA/B fusion polypeptide
  misc_feature (7190)..(7190): n is a, c, g, or t
  misc_feature (21091)..(21091): n is a, c, g, or t
  misc_feature (24027)..(24027): n is a, c, g, or t
  misc_feature (35169)..(35169): n is a, c, g, or t
cgccatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccataaagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctancatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagtcgcggccgcgatatcgctagcgaagttcctattctctagaaagtataggaacttcggatcctctagagtcgaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgttatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcgccggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgggtccctgcgccgcgccgccagcggtccgcgatcgttgcggcccgtagccagtggcaactggcaaagcacactgaacagcatcgtgggtttgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagttcgcccgcgccaccgagacgtacttcagcctgaataacaagtttagaaaccccacggtggcgcctacgcacgacgtgaccacagaccggtctcagcgtttgacgctgcggttcatccccgtggaccgcgaggatactgcgtactcgtacaaggcgcggttcaccctagctgtgggtgataaccgtgtgctagacatggcttccacgtactttgacatccgcggcgtgctggacaggggccctacttttaagccctactctggcactgcctacaacgcactggcccccaagggtgcccccaactcgtgcgagtgggaacaaaatgaaactgcacaagtggatgctcaagaacttgacgaagaggagaatgaagccaatgaagctcaggcgcgagaacaggaacaagctaagaaaacccatgtatatgcccaggctccactgtccggaataaaaataactaaagaaggtctacaaataggaactgccgacgccacagtagcaggtgccggcaaagaaattttcgcagacaaaacttttcaacctgaaccacaagtaggagaatctcaatggaacgaagcggatgccacagcagctggtggaagggttcttaaaaagacaactcccatgaaaccctgctatggctcatacgctagacccaccaattccaacggcggacagggcgttatggttgaacaaaatggtaaattggaaagtcaagtcgaaatgcaatttttttccacatccacaaatgccacaaatgaagttaacaatatacaaccaacagttgtattgtacagcgaagatgtaaacatggaaactccagatactcatctttcttataaacctaaaatgggggataaaaatgccaaagtcatgcttggacaacaagcaatgccaaacagaccaaattacattgcttttagagacaattttattggtctcatgtattacaacagcacaggtaacatgggtgtccttgctggtcaggcatcgcagttgaacgctgttgtagatttgcaagacagaaacacagagctgtcctaccagcttttgcttgattcaattggcgacagaacaagatacttttcaatgtggaatcaagctgttgacagctatgatccagatgtcagaattattgagaaccatggaactgaggatgagttgccaaattattgctttcctcttggtggaattgggattactgacacttttcaagctgttaaaacaactgctgctaacggggaccaaggcaatactacctggcaaaaagattcaacatttgcagaacgcaatgaaataggggtgggaaataactttgccatggaaattaacctgaatgccaacctatggagaaatttcctttactccaatattgcgctgtacctgccagacaagctaaaatacaaccccaccaatgtggaaatatctgacaaccccaacacctacgactacatgaacaagcgagtggtggctcctgggcttgtagactgctacattaaccttggggcgcgctggtctctggactacatggacaacgttaatccctttaaccacccccgccatgcgggcctgcgttaccgctccatgttgttgggaaacggccgctacgtgccctttcacattcaggtgccccaaaagttttttgccattaaaaacctcctcctcctgccaggctcatacacatatgaatggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcanatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttntgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgacagatctgagctcgcggccgcgatatcgctagcgaagttcctattctctagaaagtataggaacttcgatcctctagagtcgacctgcaggcatgcaagcttggcactgcaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattcgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatctaaccggtggaaagcgctaccatgccttcatccgtgtcatggggaatcctgctgctggctggactgtgctgtctggtgcctgtctcactggccgaggacccttttaatctggtgacaggctggcagactatcaatgggaagaaatactatttcgacattaacaccggcgccgctctgatcagctacaagatcattaacgggaaacacttctacttcaacaatgacggagtgatgcagctgggcgtctttaagggccccgatgggttcgagtacttcgcacctgccaatacacagaacaataacattgaaggacaggccatcgtgtatcagtccaaattcctgactctgaacggcaagaaatactattttgaccaggattctaaggccgtcaccgggtggcgaatcattaataacgagaagtactacttcaaccccaataacgctattgcagccgtgggcctgcaggtcatcgacaataacaagtactatttcaaccctgatactgccatcatttccaaaggatggcagaccgtgcagggctctcgctactatttcgacaccgatacagccatcgccttcaacgggtacaagaccatcgacggaaaacatttctattttgactcagattgcgtggtcaagatcggcgtgttcagcacctccaacggcttcgagtactttgccccagctaacacatacaacaacaacatcgagggccaggccatcgtgtaccagagcaagttcctgaccctgaatggcaagaaatactacttcgaccagaactctaaggcagtcaccgggtggcagacaatcgatagtaagaagtactacttcaacactaacaccgccgaggctgcaactggctggcagaccatcgacgggaagaaatattatttcaatacaaacactgccgaagccgctacaggatggcagactattgacggcaagaaatattacttcaacaccaacacagcaatcgcctctacagggtacactatcattaatggaaagcacttctacttcaacactgatgggatcatgcagattggagtgttcaaaggaccaaatggcttcgagtactttgctcccgcaaacacagacgccaacaatattgagggccaggctatcctgtatcagaatgaattcctgacactgaacggcaagaaatattattttgggtctgatagtaaggctgtgactggctggaggatcattaacaataagaagtactatttcaaccccaacaacgcaatcgcagccattcacctgtgcaccattaacaatgacaagtactacttcagctacgacggcatcctgcagaatgggtatatcacaattgagcgcaacaatttctactttgacgccaaccaggaatccaagatggtgaccggcgtcttcaaagggcctaatggatttgaatatttcgccccagctaacacacataataacaatatcgaggggcaggctatcgtgtatcagaataagttcctgaccctgaacggcaagaaatactactttgaccaggatagcaaagccgtgaccggatggcagacaatcgatggcaagaaatattatttcaatctgaacacagccgaggccgcaactgggtggcagaccatcgatggaaagaaatactacttcaacctgaacactgctgaagccgctaccggatggcagactatcgacgggaagaaatactatttcaatactaacacctttattgcctctaccggatacacaagtatcaatggcaagcacttctacttcaacacggatggaatcatgcagattggcgtgttcaaaggccccaacggatttgaatactttgcacctgccaacactcataataacaatattgaaggccaggctatcctgtaccaaaataagttcctgaccctgaacgggaagaaatattacttcggatcagacagcaaagccgtgaccggcctgaggacaatcgatgggaagaaatattatttcaatacgaacactgctgtggcagtcactggatggcagaccattaatggcaagaaatattacttcaacacgcagacaagcatcgcctccactgggtacaccatcattagcggaaagcacttctacttcaacaccgacggcattatgcagatcggagtgttcaaaggccctgatggatttgagtactttgcccccgctaatacagatgcaaataacattgaaggccaggccatccgataccagaaccggttcctgtatctgcatgacaatatctactattttggccagaactccaaggcagccacaggctgggtgactatcgatgggaatcggtactatttcgagcctaatacagctatgggggcaaacggatacaagactatcgataacaagaacttctacttccggaatggcctgcctcagatcggggtgtttaagggcagcaacggattcgagtactttgcaccagccaacaccgacgccaataatattgaaggccaggcaatcagataccagaacaggttcctgcatctgctgggcaaaatctactacttcggccagaattccaaagcagtgactggctggcagacaatcaacggaaaggtctactacttcatgcctgacacagcaatggctgcagccggcggactgttcgagattgacggcgtgatctacttctttggagtggatggcgtcaaagcacctggaatctacggaagaggacggagatcaagaggaaggcgcagcaacctgatcactggattcgtgaccgtcggcgacgataagtactacttcaaccctattaacggaggcgctgcatccatcggcgagaccatcatcgacgataagaactactacttccagcagagtggggtgctgcagacaggagtcttctcaactgaggacggcttcaagtactttgctccagcaaataccctggatgaaaacctggagggagaagccattgactttacaggcaagctgatcatcgatgaaaacatctactacttcgacgataactaccgcggagctgtggagtggaaagaactggacggcgagatgcactatttctctccagaaaccggcaaggccttcaaggggctgaatcagatcggagactacaagtactatttcaacagcgatggcgtgatgcagaaggggtttgtctccatcaatgacaacaaacactacttcgacgatagcggagtgatgaaggtcggctacaccgagattgatggcaaacatttctattttgctgagaatggggaaatgcaaatcggagtgttcaacacagaagatggcttcaagtactttgcccaccataatgaggacctgggcaacgaggaaggggaggaaatttcctactctggcatcctgaacttcaacaacaaaatctactatttcgacgatagcttcaccgcagtggtgggatggaaggacctggaggatggaagcaaatactattttgacgaggataccgccgaagcttacattggcctgtccctgatcaatgacgggcagtactacttcaacgacgatggcattatgcaagtggggttcgtcaccatcaacgacaaggtgttctactttagtgattcaggaatcattgagtctggcgtccagaatattgacgataactacttctatatcgacgataatgggatcgtgcagattggagtcttcgacaccagcgatgggtacaagtattttgcacccgccaacaccgtgaatgacaacatctacggccaggccgtcgagtattcaggcctggtgcgggtcggggaagacgtgtactatttcggcgagacttacaccattgaaacagggtggatctatgacatggagcaagaaagtgataagtactatttcaatcctgagactaagaaagcctgcaaaggcatcaacctgattgacgatatcaagtactacttcgatgagaagggaatcatgagaaccggcctgatcagcttcgaaaacaataactactacttcaacgagaacggggaaatgcagttcggatacatcaacatcgaggacaagatgttctacttcggggaagatggagtgatgcagatcggagtctttaacacacccgacggcttcaaatactttgcccaccagaatactctggatgagaacttcgagggggaatctatccagtacaccggatggctggacctggatgagaagaggtactatttcaccgacgagtacatcgccgctacaggcagtgtgattatcgacggcgaggagtattacttcgatcccgacaccgctcagctggtcatctcagagtaataaactagtaacggccgccagtgtgctggaattcgcccttataacttcgtatagcatacattatacgaagttattgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaataacttcgtatagcatacattatacgaagttataagggcgaattctgcagatatccatcctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacaacgtgtttatttttcaattgcagaaagaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcanggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacccctgaaaaaccctcctgcccctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatggcgat

SEQ ID NO: 28 - DNA, 36201 bp, Artificial; identical to SEQ ID NO: 26
  nucleic acid sequence of SC-Ad6-(delta)III-(delta)E3-CMV-Spike-3X-LZL
  misc_feature (7190)..(7190): n is a, c, g, or t
  misc_feature (21091)..(21091): n is a, c, g, or t
  misc_feature (24027)..(24027): n is a, c, g, or t
  misc_feature (34791)..(34791): n is a, c, g, or t

SEQ ID NO: 29 - DNA, 36201 bp, Artificial
  nucleic acid sequence of SC-Ad6- (delta)III- (delta)E3-CMV-Spike-PP-3X-LZL
  misc_feature (7190)..(7190): n is a, c, g, or t
  misc_feature (21091)..(21091): n is a, c, g, or t
  misc_feature (24027)..(24027): n is a, c, g, or t
  misc_feature (34791)..(34791): n is a, c, g, or t
cgccatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccataaagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctancatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagtcgcggccgcgatatcgctagcgaagttcctattctctagaaagtataggaacttcggatcctctagagtcgaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgttatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcgccggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgggtccctgcgccgcgccgccagcggtccgcgatcgttgcggcccgtagccagtggcaactggcaaagcacactgaacagcatcgtgggtttgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagttcgcccgcgccaccgagacgtacttcagcctgaataacaagtttagaaaccccacggtggcgcctacgcacgacgtgaccacagaccggtctcagcgtttgacgctgcggttcatccccgtggaccgcgaggatactgcgtactcgtacaaggcgcggttcaccctagctgtgggtgataaccgtgtgctagacatggcttccacgtactttgacatccgcggcgtgctggacaggggccctacttttaagccctactctggcactgcctacaacgcactggcccccaagggtgcccccaactcgtgcgagtgggaacaaaatgaaactgcacaagtggatgctcaagaacttgacgaagaggagaatgaagccaatgaagctcaggcgcgagaacaggaacaagctaagaaaacccatgtatatgcccaggctccactgtccggaataaaaataactaaagaaggtctacaaataggaactgccgacgccacagtagcaggtgccggcaaagaaattttcgcagacaaaacttttcaacctgaaccacaagtaggagaatctcaatggaacgaagcggatgccacagcagctggtggaagggttcttaaaaagacaactcccatgaaaccctgctatggctcatacgctagacccaccaattccaacggcggacagggcgttatggttgaacaaaatggtaaattggaaagtcaagtcgaaatgcaatttttttccacatccacaaatgccacaaatgaagttaacaatatacaaccaacagttgtattgtacagcgaagatgtaaacatggaaactccagatactcatctttcttataaacctaaaatgggggataaaaatgccaaagtcatgcttggacaacaagcaatgccaaacagaccaaattacattgcttttagagacaattttattggtctcatgtattacaacagcacaggtaacatgggtgtccttgctggtcaggcatcgcagttgaacgctgttgtagatttgcaagacagaaacacagagctgtcctaccagcttttgcttgattcaattggcgacagaacaagatacttttcaatgtggaatcaagctgttgacagctatgatccagatgtcagaattattgagaaccatggaactgaggatgagttgccaaattattgctttcctcttggtggaattgggattactgacacttttcaagctgttaaaacaactgctgctaacggggaccaaggcaatactacctggcaaaaagattcaacatttgcagaacgcaatgaaataggggtgggaaataactttgccatggaaattaacctgaatgccaacctatggagaaatttcctttactccaatattgcgctgtacctgccagacaagctaaaatacaaccccaccaatgtggaaatatctgacaaccccaacacctacgactacatgaacaagcgagtggtggctcctgggcttgtagactgctacattaaccttggggcgcgctggtctctggactacatggacaacgttaatccctttaaccacccccgccatgcgggcctgcgttaccgctccatgttgttgggaaacggccgctacgtgccctttcacattcaggtgccccaaaagttttttgccattaaaaacctcctcctcctgccaggctcatacacatatgaatggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcanatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttntgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgacagatctgagctcgcggccgcgatatcgctagcgaagttcctattctctagaaagtataggaacttcgatcctctagagtcgacctgcaggcatgcaagcttggcactgcaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattcgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccaccatgtttgtctttctcgtgctgctgcccctcgtgagcagccagtgcgtcaatctgacaacaaggacccagctgccccccgcctacaccaactccttcacaagaggcgtgtattaccccgataaggtcttcagatccagcgtcctccacagcacccaagatttgtttctgcctttcttcagcaacgtgacatggttccacgccattcatgtcagcggcacaaacggcacaaagaggtttgacaaccccgtgctccccttcaacgacggcgtgtacttcgccagcacagagaaatccaatatcattaggggctggatcttcggcacaacactggattccaagacccagtctctgctcattgtgaataacgccaccaacgtggtgattaaggtctgtgagtttcagttctgcaacgacccctttctgggagtctactaccacaagaataataagagctggatggagtccgagtttagggtgtacagctccgccaacaactgtaccttcgaatacgtgtcccagcctttcctcatggatctggagggcaagcaaggcaatttcaaaaatctgagagagttcgtgttcaaaaacattgatggatacttcaaaatctacagcaagcatacccccattaatctggtgagggatctgccccaaggattctccgctctggaacctctggtggatctgcccattggcattaacatcacaagattccagaccctcctcgccctccatagatcctatctgacccccggcgactcctccagcggatggacagccggagctgccgcctactacgtgggctatctgcagccaagaacctttctgctgaagtacaacgagaacggcaccatcacagacgctgtcgattgcgctctcgaccctctgagcgagaccaaatgcacactgaagagcttcaccgtggaaaagggcatctatcagaccagcaacttcagagtgcagcctaccgagagcattgtgaggtttcccaacatcaccaatctgtgtcctttcggcgaggtctttaatgccacaaggttcgcttccgtgtatgcttggaataggaagaggatcagcaattgcgtcgccgactattccgtcctctataacagcgcctccttctccaccttcaaatgttatggcgtgtcccccaccaagctcaacgacctctgcttcaccaatgtgtacgctgactccttcgtcattaggggcgacgaggtgaggcaaattgcccccggccagaccggcaagattgctgattacaactacaaactgcccgacgattttaccggctgcgtgatcgcttggaactccaacaatctggactccaaagtgggcggaaactacaattacctctacagactctttagaaaaagcaatctgaagcccttcgagagagacatctccaccgaaatctaccaagccggaagcacaccttgcaatggcgtcgagggatttaactgctacttccctctgcagagctacggctttcaacctaccaacggcgtcggatatcaaccctatagggtggtcgtgctgagctttgaactgctgcatgctcccgccaccgtctgcggacctaagaagagcaccaatctcgtcaaaaacaagtgcgtgaacttcaacttcaatggactgaccggcaccggcgtgctgaccgagagcaataagaagtttctgcccttccagcagttcggaagggatattgccgataccacagatgctgtgagggacccccaaaccctcgagattctggatatcaccccttgcagcttcggaggagtgtccgtgatcacccccggaacaaacacctccaatcaagtggctgtgctgtaccaagacgtgaactgcacagaagtccccgtggccatccatgccgaccagctgacccctacatggagagtgtactccaccggcagcaatgtgttccagacaagagccggatgcctcattggagctgaacacgtcaacaacagctacgagtgcgacattcccatcggcgccggcatttgtgcctcctatcagacccagaccaacagcccaagaagggctagaagcgtcgcttcccaatccatcattgcctacaccatgtctctgggagccgaaaactccgtcgcctactccaacaatagcatcgccatccccaccaattttaccatctccgtgaccacagagattctgcccgtgtccatgacaaagacatccgtggactgcaccatgtacatctgtggcgacagcaccgagtgtagcaatctgctgctgcaatatggcagcttctgcacccagctgaacagagccctcaccggcatcgccgtcgaacaagacaagaacacccaagaggtgttcgcccaagtgaagcaaatctacaagaccccccctatcaaagatttcggaggattcaactttagccagattctgcccgatcctagcaagccttccaagaggagcttcatcgaggatctgctgtttaataaggtgacactggccgacgctggcttcattaaacagtacggcgattgtctgggcgacatcgctgctagggatctgatctgcgctcagaagttcaacggactgacagtcctccctcctctgctgaccgacgagatgatcgctcagtataccagcgctctgctggctggaaccattaccagcggctggacattcggcgctggagccgccctccaaattccctttgccatgcagatggcctatagattcaacggcattggcgtcacccaaaatgtgctgtatgaaaatcagaagctgattgctaaccaattcaatagcgccattggcaagatccaagactctctgagctccacagccagcgccctcggaaagctgcaagacgtggtgaatcaaaacgcccaagctctgaacacactggtgaaacagctcagcagcaactttggagccatcagcagcgtgctcaatgatatcctctctaggctggaccctccggaggccgaagtccagatcgatagactcatcaccggcagactccaatctctgcagacatacgtcacccaacagctcattagagctgccgaaatcagagcctccgccaatctggccgccaccaagatgtccgagtgcgtgctgggacagagcaagagagtggacttctgtggcaagggataccatctgatgagcttcccccagagcgctccccatggagtggtctttctgcatgtcacatacgtgcccgcccaagagaagaacttcaccaccgctcccgccatttgccacgatggaaaggcccactttcccagagaaggagtgttcgtgagcaacggcacacactggtttgtcacccagagaaatttttacgagccccagattatcaccaccgacaacaccttcgtgtccggaaactgcgatgtcgtgattggcatcgtgaacaacacagtctacgaccctctgcagcccgaactcgacagcttcaaggaagagctggacaagtacttcaagaatcacacatcccccgacgtggatctgggcgacattagcggcattaatgcctccgtcgtcaacattcagaaggagattgatagactgaatgaagtcgccaagaacctcaatgagtctctgattgatctgcaagagctgggcaagtacgagcaatacatcaaatggccttggtacatctggctgggattcatcgctggactcatcgccatcgtgatggtcaccattatgctgtgttgcatgaccagctgctgcagctgtctgaagggctgctgcagctgcggaagctgctgcaagtttgacgaagacgactccgagcccgtgctgaagggcgtcaagctgcattatacataaactagtgctggaattcgcccttatagagtgctggaattcgcccttatagagtgctggaattcgcccttatatctagtaacggccgccagtgtgctggaattcgcccttataacttcgtatagcatacattatacgaagttattgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaataacttcgtatagcatacattatacgaagttataagggcgaattctgcagatatccatcctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacaacgtgtttatttttcaattgcagaaagaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcanggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacccctgaaaaaccctcctgcccctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatggcgat

SEQ ID NO: 30 - DNA, 36859 bp, Artificial
  nucleic acid sequence of SC-Ad6- (delta)III- (delta)E3ADP-I-CMV-Spike-3X-L
  misc_feature (7190)..(7190): n is a, c, g, or t
  misc_feature (21091)..(21091): n is a, c, g, or t
  misc_feature (24027)..(24027): n is a, c, g, or t
  misc_feature (35449)..(35449): n is a, c, g, or t
cgccatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccataaagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctancatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagtcgcggccgcgatatcgctagcgaagttcctattctctagaaagtataggaacttcggatcctctagagtcgaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgttatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcgccggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgggtccctgcgccgcgccgccagcggtccgcgatcgttgcggcccgtagccagtggcaactggcaaagcacactgaacagcatcgtgggtttgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagttcgcccgcgccaccgagacgtacttcagcctgaataacaagtttagaaaccccacggtggcgcctacgcacgacgtgaccacagaccggtctcagcgtttgacgctgcggttcatccccgtggaccgcgaggatactgcgtactcgtacaaggcgcggttcaccctagctgtgggtgataaccgtgtgctagacatggcttccacgtactttgacatccgcggcgtgctggacaggggccctacttttaagccctactctggcactgcctacaacgcactggcccccaagggtgcccccaactcgtgcgagtgggaacaaaatgaaactgcacaagtggatgctcaagaacttgacgaagaggagaatgaagccaatgaagctcaggcgcgagaacaggaacaagctaagaaaacccatgtatatgcccaggctccactgtccggaataaaaataactaaagaaggtctacaaataggaactgccgacgccacagtagcaggtgccggcaaagaaattttcgcagacaaaacttttcaacctgaaccacaagtaggagaatctcaatggaacgaagcggatgccacagcagctggtggaagggttcttaaaaagacaactcccatgaaaccctgctatggctcatacgctagacccaccaattccaacggcggacagggcgttatggttgaacaaaatggtaaattggaaagtcaagtcgaaatgcaatttttttccacatccacaaatgccacaaatgaagttaacaatatacaaccaacagttgtattgtacagcgaagatgtaaacatggaaactccagatactcatctttcttataaacctaaaatgggggataaaaatgccaaagtcatgcttggacaacaagcaatgccaaacagaccaaattacattgcttttagagacaattttattggtctcatgtattacaacagcacaggtaacatgggtgtccttgctggtcaggcatcgcagttgaacgctgttgtagatttgcaagacagaaacacagagctgtcctaccagcttttgcttgattcaattggcgacagaacaagatacttttcaatgtggaatcaagctgttgacagctatgatccagatgtcagaattattgagaaccatggaactgaggatgagttgccaaattattgctttcctcttggtggaattgggattactgacacttttcaagctgttaaaacaactgctgctaacggggaccaaggcaatactacctggcaaaaagattcaacatttgcagaacgcaatgaaataggggtgggaaataactttgccatggaaattaacctgaatgccaacctatggagaaatttcctttactccaatattgcgctgtacctgccagacaagctaaaatacaaccccaccaatgtggaaatatctgacaaccccaacacctacgactacatgaacaagcgagtggtggctcctgggcttgtagactgctacattaaccttggggcgcgctggtctctggactacatggacaacgttaatccctttaaccacccccgccatgcgggcctgcgttaccgctccatgttgttgggaaacggccgctacgtgccctttcacattcaggtgccccaaaagttttttgccattaaaaacctcctcctcctgccaggctcatacacatatgaatggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcanatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttntgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgcgtggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgaatgaccagtggagaggcagagcaactgcgcctgacacacctcgaccactgccgccgccacaagtgctttgcccgcggctccggtgagttttgttactttgaattgcccgaagagcatatcgagggcccggcgcacggcgtccggctcaccacccaggtagggataacagggtaattgagacatgattcctcgagtccttatattattgacccttgttgcgcttttctgtgcgtgctctacattggctgcggtcgctcacatcgaagtagattgcatcccacctttcacagtttacctgctttacggatttgtcacccttatcctcatctgcagcctcgtcactgtagtcatcgccttcattcagttcattgactggatttgtgtgcgcattgcgtaccttaggcaccatccgcaatacagagacaggactatagctgatcttctcagaattctttaattatgaaacggattgtcacttttgttttgctgattttctgcgccctacctgtgctttgctcccaaacctcagcgcctcccaaaagacatatttcctgcagattcactcaaatatggaacattcccagctgctacaacaaacagagcgatttgtcagaagcctggttatacgccatcatctctgtcatggttttttgcagtaccatttttgccctagccatatacccataccttgacattggttggaatgccatagatgccatgaaccaccctactttcccagcgcccaatgtcataccactgcaacaggttattgccccaatcaatcagcctcgccccccttctcccacccccactgagattagctactttaatttgacaggtggagatgactgaatctctagatctagaattggatggaattaacaccgaacagcgcctactagaaaggcgcaaggcggcgtccgagcgagaacgcctaaaacaagaagttgaagacatggttaacctgcaccagtgtaaaagaggtatcttttgtgtggtcaagcaggccaaacttacctacgaaaaaaccactaccggcaaccgccttagctacaagctacccacccagcgccaaaaactggtgcttatggtgggagaaaaacctatcaccgtcacccagcactcggcagaaacagaaggctgcctgcacttcccctatcagggtccagaggacctctgcactcttattaaaaccatgtgtggcattagagatcttattccattcaactaacaataaacacacaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattcgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccaccatgtttgtctttctcgtgctgctgcccctcgtgagcagccagtgcgtcaatctgacaacaaggacccagctgccccccgcctacaccaactccttcacaagaggcgtgtattaccccgataaggtcttcagatccagcgtcctccacagcacccaagatttgtttctgcctttcttcagcaacgtgacatggttccacgccattcatgtcagcggcacaaacggcacaaagaggtttgacaaccccgtgctccccttcaacgacggcgtgtacttcgccagcacagagaaatccaatatcattaggggctggatcttcggcacaacactggattccaagacccagtctctgctcattgtgaataacgccaccaacgtggtgattaaggtctgtgagtttcagttctgcaacgacccctttctgggagtctactaccacaagaataataagagctggatggagtccgagtttagggtgtacagctccgccaacaactgtaccttcgaatacgtgtcccagcctttcctcatggatctggagggcaagcaaggcaatttcaaaaatctgagagagttcgtgttcaaaaacattgatggatacttcaaaatctacagcaagcatacccccattaatctggtgagggatctgccccaaggattctccgctctggaacctctggtggatctgcccattggcattaacatcacaagattccagaccctcctcgccctccatagatcctatctgacccccggcgactcctccagcggatggacagccggagctgccgcctactacgtgggctatctgcagccaagaacctttctgctgaagtacaacgagaacggcaccatcacagacgctgtcgattgcgctctcgaccctctgagcgagaccaaatgcacactgaagagcttcaccgtggaaaagggcatctatcagaccagcaacttcagagtgcagcctaccgagagcattgtgaggtttcccaacatcaccaatctgtgtcctttcggcgaggtctttaatgccacaaggttcgcttccgtgtatgcttggaataggaagaggatcagcaattgcgtcgccgactattccgtcctctataacagcgcctccttctccaccttcaaatgttatggcgtgtcccccaccaagctcaacgacctctgcttcaccaatgtgtacgctgactccttcgtcattaggggcgacgaggtgaggcaaattgcccccggccagaccggcaagattgctgattacaactacaaactgcccgacgattttaccggctgcgtgatcgcttggaactccaacaatctggactccaaagtgggcggaaactacaattacctctacagactctttagaaaaagcaatctgaagcccttcgagagagacatctccaccgaaatctaccaagccggaagcacaccttgcaatggcgtcgagggatttaactgctacttccctctgcagagctacggctttcaacctaccaacggcgtcggatatcaaccctatagggtggtcgtgctgagctttgaactgctgcatgctcccgccaccgtctgcggacctaagaagagcaccaatctcgtcaaaaacaagtgcgtgaacttcaacttcaatggactgaccggcaccggcgtgctgaccgagagcaataagaagtttctgcccttccagcagttcggaagggatattgccgataccacagatgctgtgagggacccccaaaccctcgagattctggatatcaccccttgcagcttcggaggagtgtccgtgatcacccccggaacaaacacctccaatcaagtggctgtgctgtaccaagacgtgaactgcacagaagtccccgtggccatccatgccgaccagctgacccctacatggagagtgtactccaccggcagcaatgtgttccagacaagagccggatgcctcattggagctgaacacgtcaacaacagctacgagtgcgacattcccatcggcgccggcatttgtgcctcctatcagacccagaccaacagcccaagaagggctagaagcgtcgcttcccaatccatcattgcctacaccatgtctctgggagccgaaaactccgtcgcctactccaacaatagcatcgccatccccaccaattttaccatctccgtgaccacagagattctgcccgtgtccatgacaaagacatccgtggactgcaccatgtacatctgtggcgacagcaccgagtgtagcaatctgctgctgcaatatggcagcttctgcacccagctgaacagagccctcaccggcatcgccgtcgaacaagacaagaacacccaagaggtgttcgcccaagtgaagcaaatctacaagaccccccctatcaaagatttcggaggattcaactttagccagattctgcccgatcctagcaagccttccaagaggagcttcatcgaggatctgctgtttaataaggtgacactggccgacgctggcttcattaaacagtacggcgattgtctgggcgacatcgctgctagggatctgatctgcgctcagaagttcaacggactgacagtcctccctcctctgctgaccgacgagatgatcgctcagtataccagcgctctgctggctggaaccattaccagcggctggacattcggcgctggagccgccctccaaattccctttgccatgcagatggcctatagattcaacggcattggcgtcacccaaaatgtgctgtatgaaaatcagaagctgattgctaaccaattcaatagcgccattggcaagatccaagactctctgagctccacagccagcgccctcggaaagctgcaagacgtggtgaatcaaaacgcccaagctctgaacacactggtgaaacagctcagcagcaactttggagccatcagcagcgtgctcaatgatatcctctctaggctggacaaagtggaggccgaagtccagatcgatagactcatcaccggcagactccaatctctgcagacatacgtcacccaacagctcattagagctgccgaaatcagagcctccgccaatctggccgccaccaagatgtccgagtgcgtgctgggacagagcaagagagtggacttctgtggcaagggataccatctgatgagcttcccccagagcgctccccatggagtggtctttctgcatgtcacatacgtgcccgcccaagagaagaacttcaccaccgctcccgccatttgccacgatggaaaggcccactttcccagagaaggagtgttcgtgagcaacggcacacactggtttgtcacccagagaaatttttacgagccccagattatcaccaccgacaacaccttcgtgtccggaaactgcgatgtcgtgattggcatcgtgaacaacacagtctacgaccctctgcagcccgaactcgacagcttcaaggaagagctggacaagtacttcaagaatcacacatcccccgacgtggatctgggcgacattagcggcattaatgcctccgtcgtcaacattcagaaggagattgatagactgaatgaagtcgccaagaacctcaatgagtctctgattgatctgcaagagctgggcaagtacgagcaatacatcaaatggccttggtacatctggctgggattcatcgctggactcatcgccatcgtgatggtcaccattatgctgtgttgcatgaccagctgctgcagctgtctgaagggctgctgcagctgcggaagctgctgcaagtttgacgaagacgactccgagcccgtgctgaagggcgtcaagctgcattatacataaactagtgctggaattcgcccttatagagtgctggaattcgcccttatagagtgctggaattcgcccttatatctagtaacggccgccagtgtgctggaattcgcccttataacttcgtatagcatacattatacgaagttataagggcgaattctgcagatatccatcctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacaacgtgtttatttttcaattgcagaaagaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcanggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacccctgaaaaaccctcctgcccctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatggcgat

SEQ ID NO: 31 - DNA, 36859 bp, Artificial
  nucleic acid sequence of a SC-Ad6-(delta)III-(delta)E3ADP-I-CMV-Spike-PP-3X-L
  misc_feature (7190)..(7190): n is a, c, g, or t
  misc_feature (21091)..(21091): n is a, c, g, or t
  misc_feature (24027)..(24027): n is a, c, g, or t
  misc_feature (35449)..(35449): n is a, c, g, or t
cgccatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccataaagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctancatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagtcgcggccgcgatatcgctagcgaagttcctattctctagaaagtataggaacttcggatcctctagagtcgaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgttatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcgccggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgggtccctgcgccgcgccgccagcggtccgcgatcgttgcggcccgtagccagtggcaactggcaaagcacactgaacagcatcgtgggtttgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagttcgcccgcgccaccgagacgtacttcagcctgaataacaagtttagaaaccccacggtggcgcctacgcacgacgtgaccacagaccggtctcagcgtttgacgctgcggttcatccccgtggaccgcgaggatactgcgtactcgtacaaggcgcggttcaccctagctgtgggtgataaccgtgtgctagacatggcttccacgtactttgacatccgcggcgtgctggacaggggccctacttttaagccctactctggcactgcctacaacgcactggcccccaagggtgcccccaactcgtgcgagtgggaacaaaatgaaactgcacaagtggatgctcaagaacttgacgaagaggagaatgaagccaatgaagctcaggcgcgagaacaggaacaagctaagaaaacccatgtatatgcccaggctccactgtccggaataaaaataactaaagaaggtctacaaataggaactgccgacgccacagtagcaggtgccggcaaagaaattttcgcagacaaaacttttcaacctgaaccacaagtaggagaatctcaatggaacgaagcggatgccacagcagctggtggaagggttcttaaaaagacaactcccatgaaaccctgctatggctcatacgctagacccaccaattccaacggcggacagggcgttatggttgaacaaaatggtaaattggaaagtcaagtcgaaatgcaatttttttccacatccacaaatgccacaaatgaagttaacaatatacaaccaacagttgtattgtacagcgaagatgtaaacatggaaactccagatactcatctttcttataaacctaaaatgggggataaaaatgccaaagtcatgcttggacaacaagcaatgccaaacagaccaaattacattgcttttagagacaattttattggtctcatgtattacaacagcacaggtaacatgggtgtccttgctggtcaggcatcgcagttgaacgctgttgtagatttgcaagacagaaacacagagctgtcctaccagcttttgcttgattcaattggcgacagaacaagatacttttcaatgtggaatcaagctgttgacagctatgatccagatgtcagaattattgagaaccatggaactgaggatgagttgccaaattattgctttcctcttggtggaattgggattactgacacttttcaagctgttaaaacaactgctgctaacggggaccaaggcaatactacctggcaaaaagattcaacatttgcagaacgcaatgaaataggggtgggaaataactttgccatggaaattaacctgaatgccaacctatggagaaatttcctttactccaatattgcgctgtacctgccagacaagctaaaatacaaccccaccaatgtggaaatatctgacaaccccaacacctacgactacatgaacaagcgagtggtggctcctgggcttgtagactgctacattaaccttggggcgcgctggtctctggactacatggacaacgttaatccctttaaccacccccgccatgcgggcctgcgttaccgctccatgttgttgggaaacggccgctacgtgccctttcacattcaggtgccccaaaagttttttgccattaaaaacctcctcctcctgccaggctcatacacatatgaatggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcanatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttntgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgcgtggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgaatgaccagtggagaggcagagcaactgcgcctgacacacctcgaccactgccgccgccacaagtgctttgcccgcggctccggtgagttttgttactttgaattgcccgaagagcatatcgagggcccggcgcacggcgtccggctcaccacccaggtagggataacagggtaattgagacatgattcctcgagtccttatattattgacccttgttgcgcttttctgtgcgtgctctacattggctgcggtcgctcacatcgaagtagattgcatcccacctttcacagtttacctgctttacggatttgtcacccttatcctcatctgcagcctcgtcactgtagtcatcgccttcattcagttcattgactggatttgtgtgcgcattgcgtaccttaggcaccatccgcaatacagagacaggactatagctgatcttctcagaattctttaattatgaaacggattgtcacttttgttttgctgattttctgcgccctacctgtgctttgctcccaaacctcagcgcctcccaaaagacatatttcctgcagattcactcaaatatggaacattcccagctgctacaacaaacagagcgatttgtcagaagcctggttatacgccatcatctctgtcatggttttttgcagtaccatttttgccctagccatatacccataccttgacattggttggaatgccatagatgccatgaaccaccctactttcccagcgcccaatgtcataccactgcaacaggttattgccccaatcaatcagcctcgccccccttctcccacccccactgagattagctactttaatttgacaggtggagatgactgaatctctagatctagaattggatggaattaacaccgaacagcgcctactagaaaggcgcaaggcggcgtccgagcgagaacgcctaaaacaagaagttgaagacatggttaacctgcaccagtgtaaaagaggtatcttttgtgtggtcaagcaggccaaacttacctacgaaaaaaccactaccggcaaccgccttagctacaagctacccacccagcgccaaaaactggtgcttatggtgggagaaaaacctatcaccgtcacccagcactcggcagaaacagaaggctgcctgcacttcccctatcagggtccagaggacctctgcactcttattaaaaccatgtgtggcattagagatcttattccattcaactaacaataaacacacaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattcgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccaccatgtttgtctttctcgtgctgctgcccctcgtgagcagccagtgcgtcaatctgacaacaaggacccagctgccccccgcctacaccaactccttcacaagaggcgtgtattaccccgataaggtcttcagatccagcgtcctccacagcacccaagatttgtttctgcctttcttcagcaacgtgacatggttccacgccattcatgtcagcggcacaaacggcacaaagaggtttgacaaccccgtgctccccttcaacgacggcgtgtacttcgccagcacagagaaatccaatatcattaggggctggatcttcggcacaacactggattccaagacccagtctctgctcattgtgaataacgccaccaacgtggtgattaaggtctgtgagtttcagttctgcaacgacccctttctgggagtctactaccacaagaataataagagctggatggagtccgagtttagggtgtacagctccgccaacaactgtaccttcgaatacgtgtcccagcctttcctcatggatctggagggcaagcaaggcaatttcaaaaatctgagagagttcgtgttcaaaaacattgatggatacttcaaaatctacagcaagcatacccccattaatctggtgagggatctgccccaaggattctccgctctggaacctctggtggatctgcccattggcattaacatcacaagattccagaccctcctcgccctccatagatcctatctgacccccggcgactcctccagcggatggacagccggagctgccgcctactacgtgggctatctgcagccaagaacctttctgctgaagtacaacgagaacggcaccatcacagacgctgtcgattgcgctctcgaccctctgagcgagaccaaatgcacactgaagagcttcaccgtggaaaagggcatctatcagaccagcaacttcagagtgcagcctaccgagagcattgtgaggtttcccaacatcaccaatctgtgtcctttcggcgaggtctttaatgccacaaggttcgcttccgtgtatgcttggaataggaagaggatcagcaattgcgtcgccgactattccgtcctctataacagcgcctccttctccaccttcaaatgttatggcgtgtcccccaccaagctcaacgacctctgcttcaccaatgtgtacgctgactccttcgtcattaggggcgacgaggtgaggcaaattgcccccggccagaccggcaagattgctgattacaactacaaactgcccgacgattttaccggctgcgtgatcgcttggaactccaacaatctggactccaaagtgggcggaaactacaattacctctacagactctttagaaaaagcaatctgaagcccttcgagagagacatctccaccgaaatctaccaagccggaagcacaccttgcaatggcgtcgagggatttaactgctacttccctctgcagagctacggctttcaacctaccaacggcgtcggatatcaaccctatagggtggtcgtgctgagctttgaactgctgcatgctcccgccaccgtctgcggacctaagaagagcaccaatctcgtcaaaaacaagtgcgtgaacttcaacttcaatggactgaccggcaccggcgtgctgaccgagagcaataagaagtttctgcccttccagcagttcggaagggatattgccgataccacagatgctgtgagggacccccaaaccctcgagattctggatatcaccccttgcagcttcggaggagtgtccgtgatcacccccggaacaaacacctccaatcaagtggctgtgctgtaccaagacgtgaactgcacagaagtccccgtggccatccatgccgaccagctgacccctacatggagagtgtactccaccggcagcaatgtgttccagacaagagccggatgcctcattggagctgaacacgtcaacaacagctacgagtgcgacattcccatcggcgccggcatttgtgcctcctatcagacccagaccaacagcccaagaagggctagaagcgtcgcttcccaatccatcattgcctacaccatgtctctgggagccgaaaactccgtcgcctactccaacaatagcatcgccatccccaccaattttaccatctccgtgaccacagagattctgcccgtgtccatgacaaagacatccgtggactgcaccatgtacatctgtggcgacagcaccgagtgtagcaatctgctgctgcaatatggcagcttctgcacccagctgaacagagccctcaccggcatcgccgtcgaacaagacaagaacacccaagaggtgttcgcccaagtgaagcaaatctacaagaccccccctatcaaagatttcggaggattcaactttagccagattctgcccgatcctagcaagccttccaagaggagcttcatcgaggatctgctgtttaataaggtgacactggccgacgctggcttcattaaacagtacggcgattgtctgggcgacatcgctgctagggatctgatctgcgctcagaagttcaacggactgacagtcctccctcctctgctgaccgacgagatgatcgctcagtataccagcgctctgctggctggaaccattaccagcggctggacattcggcgctggagccgccctccaaattccctttgccatgcagatggcctatagattcaacggcattggcgtcacccaaaatgtgctgtatgaaaatcagaagctgattgctaaccaattcaatagcgccattggcaagatccaagactctctgagctccacagccagcgccctcggaaagctgcaagacgtggtgaatcaaaacgcccaagctctgaacacactggtgaaacagctcagcagcaactttggagccatcagcagcgtgctcaatgatatcctctctaggctggaccctccggaggccgaagtccagatcgatagactcatcaccggcagactccaatctctgcagacatacgtcacccaacagctcattagagctgccgaaatcagagcctccgccaatctggccgccaccaagatgtccgagtgcgtgctgggacagagcaagagagtggacttctgtggcaagggataccatctgatgagcttcccccagagcgctccccatggagtggtctttctgcatgtcacatacgtgcccgcccaagagaagaacttcaccaccgctcccgccatttgccacgatggaaaggcccactttcccagagaaggagtgttcgtgagcaacggcacacactggtttgtcacccagagaaatttttacgagccccagattatcaccaccgacaacaccttcgtgtccggaaactgcgatgtcgtgattggcatcgtgaacaacacagtctacgaccctctgcagcccgaactcgacagcttcaaggaagagctggacaagtacttcaagaatcacacatcccccgacgtggatctgggcgacattagcggcattaatgcctccgtcgtcaacattcagaaggagattgatagactgaatgaagtcgccaagaacctcaatgagtctctgattgatctgcaagagctgggcaagtacgagcaatacatcaaatggccttggtacatctggctgggattcatcgctggactcatcgccatcgtgatggtcaccattatgctgtgttgcatgaccagctgctgcagctgtctgaagggctgctgcagctgcggaagctgctgcaagtttgacgaagacgactccgagcccgtgctgaagggcgtcaagctgcattatacataaactagtgctggaattcgcccttatagagtgctggaattcgcccttatagagtgctggaattcgcccttatatctagtaacggccgccagtgtgctggaattcgcccttataacttcgtatagcatacattatacgaagttataagggcgaattctgcagatatccatcctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacaacgtgtttatttttcaattgcagaaagaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcanggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacccctgaaaaaccctcctgcccctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatggcgat

SEQ ID NO: 32 - DNA, 36281 bp, Artificial
  nucleic acid sequence of SC-Ad-FZF-657-(delta)IIIF-(delta)E3-Spike-3X-L
  misc_feature (7190)..(7190): n is a, c, g, or t
  misc_feature (21647)..(21647): n is a, c, g, or t
  misc_feature (24583)..(24583): n is a, c, g, or t
  misc_feature (34871)..(34871): n is a, c, g, or t
cgccatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccataaagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctancatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagtcgcggccgcgatatcgctagcgaagttcctattctctagaaagtataggaacttcggatcctctagagtcgaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgttatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcgccggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgggtccctgcgccgcgccgccagcggtccgcgatcgttgcggcccgtagccagtggcaactggcaaagcacactgaacagcatcgtgggtctgggggtgcaatccctgaagcgccgacgatgcttctgatcgcggccgcgatatcgctagcgaagttcctattctctagaaagtataggaacttctcgatcgagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgagaattcgaagttcctattctctagaaagtataggaacttcggatcctctagagtcgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccccacttttaagccctactccggcactgcctacaacgccctagctcccaagggtgcccccaactcatgcgagtgggatgaagatgatactcaggtacaggtagcggctgaagacgatcaagacgacgacgaagaagaggaacaactacctcagcagagaaatggcaaaaaaactcacgtatatgctcaggcaccgtttgctggcgaagcaattaacaaaaacggcctgcagataggaactaacggtgcagccactgaaggaaataaggaaatttacgcagataaaacttatcaacctgaaccacaaataggagaatcacagtggaacgaagccgaatcgtccgtagcaggtggaagggttcttaaaaagactactcccatgaaaccatgctatggctcctatgccagacctaccaattctaacggaggtcagggcgttatggttgaacaaaatggtaaattggaaagtcaagtagaaatgcaatttttttcaacttctgtaaatgctatgaacgaggcaaacgctattcaacctaaactagtgttgtatagtgaagatgtaaatatggaaaccccagacactcatctttcttataagcctggaaaaagtgatgataattctaaggcaatgttgggtcaacaatctatgccaaacagacccaattacatagctttcagggacaattttattggcctaatgtattacaacagcactggtaacatgggtgttcttgctggtcaggcatcacagctaaatgctgtcgtagatttgcaagacagaaacacagagctgtcctaccaacttttgcttgattctattggtgatcgaaccagatacttttccatgtggaatcaggctgtagacagctacgatccagatgttagaattatcgagaaccatggaactgaggatgaattgccaaattattgttttcctcttggcggaattggggtgacggacacctatcaagctattaaggctacaaatggaaatggaggcgccactacctgggctcaggacaatacttttgcagaacgaaatgaaataggggtgggaaataactttgccatggaaattaacctgaatgccaacctatggagaaatttcctttactccaatattgcgctgtacctgccagacaagctaaaatacaaccccaccaatgtggaaatatctgacaatcccaacacctacgactacatgaacaagcgagtggtggctcccgggctggtggattgctacattaaccttggggcgcgctggtctctggactacatggacaacgttaatccctttaaccaccaccgcaatgcgggcctgcgttaccgctccatgttgttgggaaacggccgctacgtgccctttcacattcaggtgccccaaaagttttttgccattaaaaacctcctcctcctgccaggctcatacacatatgaatggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcanatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttntgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgacagatctgagctcgcggccgcgatatcgctagcgaagttcctattctctagaaagtataggaacttcgatcctctagagtcgacctgcaggcatgcaagcttggcactgcaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattcgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccaccatgtttgtctttctcgtgctgctgcccctcgtgagcagccagtgcgtcaatctgacaacaaggacccagctgccccccgcctacaccaactccttcacaagaggcgtgtattaccccgataaggtcttcagatccagcgtcctccacagcacccaagatttgtttctgcctttcttcagcaacgtgacatggttccacgccattcatgtcagcggcacaaacggcacaaagaggtttgacaaccccgtgctccccttcaacgacggcgtgtacttcgccagcacagagaaatccaatatcattaggggctggatcttcggcacaacactggattccaagacccagtctctgctcattgtgaataacgccaccaacgtggtgattaaggtctgtgagtttcagttctgcaacgacccctttctgggagtctactaccacaagaataataagagctggatggagtccgagtttagggtgtacagctccgccaacaactgtaccttcgaatacgtgtcccagcctttcctcatggatctggagggcaagcaaggcaatttcaaaaatctgagagagttcgtgttcaaaaacattgatggatacttcaaaatctacagcaagcatacccccattaatctggtgagggatctgccccaaggattctccgctctggaacctctggtggatctgcccattggcattaacatcacaagattccagaccctcctcgccctccatagatcctatctgacccccggcgactcctccagcggatggacagccggagctgccgcctactacgtgggctatctgcagccaagaacctttctgctgaagtacaacgagaacggcaccatcacagacgctgtcgattgcgctctcgaccctctgagcgagaccaaatgcacactgaagagcttcaccgtggaaaagggcatctatcagaccagcaacttcagagtgcagcctaccgagagcattgtgaggtttcccaacatcaccaatctgtgtcctttcggcgaggtctttaatgccacaaggttcgcttccgtgtatgcttggaataggaagaggatcagcaattgcgtcgccgactattccgtcctctataacagcgcctccttctccaccttcaaatgttatggcgtgtcccccaccaagctcaacgacctctgcttcaccaatgtgtacgctgactccttcgtcattaggggcgacgaggtgaggcaaattgcccccggccagaccggcaagattgctgattacaactacaaactgcccgacgattttaccggctgcgtgatcgcttggaactccaacaatctggactccaaagtgggcggaaactacaattacctctacagactctttagaaaaagcaatctgaagcccttcgagagagacatctccaccgaaatctaccaagccggaagcacaccttgcaatggcgtcgagggatttaactgctacttccctctgcagagctacggctttcaacctaccaacggcgtcggatatcaaccctatagggtggtcgtgctgagctttgaactgctgcatgctcccgccaccgtctgcggacctaagaagagcaccaatctcgtcaaaaacaagtgcgtgaacttcaacttcaatggactgaccggcaccggcgtgctgaccgagagcaataagaagtttctgcccttccagcagttcggaagggatattgccgataccacagatgctgtgagggacccccaaaccctcgagattctggatatcaccccttgcagcttcggaggagtgtccgtgatcacccccggaacaaacacctccaatcaagtggctgtgctgtaccaagacgtgaactgcacagaagtccccgtggccatccatgccgaccagctgacccctacatggagagtgtactccaccggcagcaatgtgttccagacaagagccggatgcctcattggagctgaacacgtcaacaacagctacgagtgcgacattcccatcggcgccggcatttgtgcctcctatcagacccagaccaacagcccaagaagggctagaagcgtcgcttcccaatccatcattgcctacaccatgtctctgggagccgaaaactccgtcgcctactccaacaatagcatcgccatccccaccaattttaccatctccgtgaccacagagattctgcccgtgtccatgacaaagacatccgtggactgcaccatgtacatctgtggcgacagcaccgagtgtagcaatctgctgctgcaatatggcagcttctgcacccagctgaacagagccctcaccggcatcgccgtcgaacaagacaagaacacccaagaggtgttcgcccaagtgaagcaaatctacaagaccccccctatcaaagatttcggaggattcaactttagccagattctgcccgatcctagcaagccttccaagaggagcttcatcgaggatctgctgtttaataaggtgacactggccgacgctggcttcattaaacagtacggcgattgtctgggcgacatcgctgctagggatctgatctgcgctcagaagttcaacggactgacagtcctccctcctctgctgaccgacgagatgatcgctcagtataccagcgctctgctggctggaaccattaccagcggctggacattcggcgctggagccgccctccaaattccctttgccatgcagatggcctatagattcaacggcattggcgtcacccaaaatgtgctgtatgaaaatcagaagctgattgctaaccaattcaatagcgccattggcaagatccaagactctctgagctccacagccagcgccctcggaaagctgcaagacgtggtgaatcaaaacgcccaagctctgaacacactggtgaaacagctcagcagcaactttggagccatcagcagcgtgctcaatgatatcctctctaggctggacaaagtggaggccgaagtccagatcgatagactcatcaccggcagactccaatctctgcagacatacgtcacccaacagctcattagagctgccgaaatcagagcctccgccaatctggccgccaccaagatgtccgagtgcgtgctgggacagagcaagagagtggacttctgtggcaagggataccatctgatgagcttcccccagagcgctccccatggagtggtctttctgcatgtcacatacgtgcccgcccaagagaagaacttcaccaccgctcccgccatttgccacgatggaaaggcccactttcccagagaaggagtgttcgtgagcaacggcacacactggtttgtcacccagagaaatttttacgagccccagattatcaccaccgacaacaccttcgtgtccggaaactgcgatgtcgtgattggcatcgtgaacaacacagtctacgaccctctgcagcccgaactcgacagcttcaaggaagagctggacaagtacttcaagaatcacacatcccccgacgtggatctgggcgacattagcggcattaatgcctccgtcgtcaacattcagaaggagattgatagactgaatgaagtcgccaagaacctcaatgagtctctgattgatctgcaagagctgggcaagtacgagcaatacatcaaatggccttggtacatctggctgggattcatcgctggactcatcgccatcgtgatggtcaccattatgctgtgttgcatgaccagctgctgcagctgtctgaagggctgctgcagctgcggaagctgctgcaagtttgacgaagacgactccgagcccgtgctgaagggcgtcaagctgcattatacataaactagtgctggaattcgcccttatagagtgctggaattcgcccttatagagtgctggaattcgcccttatatctagtaacggccgccagtgtgctggaattcgcccttataacttcgtatagcatacattatacgaagttataagggcgaattctgcagatatccatcctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacaacgtgtttatttttcaattgcagaaagaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcanggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacccctgaaaaaccctcctgcccctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatggcgat

SEQ ID NO: 33 - DNA, 36281 bp, Artificial
  nucleic acid sequence of SC-Ad-FZF-657-(delta)IIIF-(delta)E3-SpikePP-3X-L
  misc_feature (7190)..(7190): n is a, c, g, or t
  misc_feature (21647)..(21647): n is a, c, g, or t
  misc_feature (24583)..(24583): n is a, c, g, or t
  misc_feature (34871)..(34871): n is a, c, g, or t
cgccatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccataaagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctancatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagtcgcggccgcgatatcgctagcgaagttcctattctctagaaagtataggaacttcggatcctctagagtcgaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgttatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcgccggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgggtccctgcgccgcgccgccagcggtccgcgatcgttgcggcccgtagccagtggcaactggcaaagcacactgaacagcatcgtgggtctgggggtgcaatccctgaagcgccgacgatgcttctgatcgcggccgcgatatcgctagcgaagttcctattctctagaaagtataggaacttctcgatcgagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgagaattcgaagttcctattctctagaaagtataggaacttcggatcctctagagtcgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccccacttttaagccctactccggcactgcctacaacgccctagctcccaagggtgcccccaactcatgcgagtgggatgaagatgatactcaggtacaggtagcggctgaagacgatcaagacgacgacgaagaagaggaacaactacctcagcagagaaatggcaaaaaaactcacgtatatgctcaggcaccgtttgctggcgaagcaattaacaaaaacggcctgcagataggaactaacggtgcagccactgaaggaaataaggaaatttacgcagataaaacttatcaacctgaaccacaaataggagaatcacagtggaacgaagccgaatcgtccgtagcaggtggaagggttcttaaaaagactactcccatgaaaccatgctatggctcctatgccagacctaccaattctaacggaggtcagggcgttatggttgaacaaaatggtaaattggaaagtcaagtagaaatgcaatttttttcaacttctgtaaatgctatgaacgaggcaaacgctattcaacctaaactagtgttgtatagtgaagatgtaaatatggaaaccccagacactcatctttcttataagcctggaaaaagtgatgataattctaaggcaatgttgggtcaacaatctatgccaaacagacccaattacatagctttcagggacaattttattggcctaatgtattacaacagcactggtaacatgggtgttcttgctggtcaggcatcacagctaaatgctgtcgtagatttgcaagacagaaacacagagctgtcctaccaacttttgcttgattctattggtgatcgaaccagatacttttccatgtggaatcaggctgtagacagctacgatccagatgttagaattatcgagaaccatggaactgaggatgaattgccaaattattgttttcctcttggcggaattggggtgacggacacctatcaagctattaaggctacaaatggaaatggaggcgccactacctgggctcaggacaatacttttgcagaacgaaatgaaataggggtgggaaataactttgccatggaaattaacctgaatgccaacctatggagaaatttcctttactccaatattgcgctgtacctgccagacaagctaaaatacaaccccaccaatgtggaaatatctgacaatcccaacacctacgactacatgaacaagcgagtggtggctcccgggctggtggattgctacattaaccttggggcgcgctggtctctggactacatggacaacgttaatccctttaaccaccaccgcaatgcgggcctgcgttaccgctccatgttgttgggaaacggccgctacgtgccctttcacattcaggtgccccaaaagttttttgccattaaaaacctcctcctcctgccaggctcatacacatatgaatggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcanatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttntgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgacagatctgagctcgcggccgcgatatcgctagcgaagttcctattctctagaaagtataggaacttcgatcctctagagtcgacctgcaggcatgcaagcttggcactgcaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattcgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccaccatgtttgtctttctcgtgctgctgcccctcgtgagcagccagtgcgtcaatctgacaacaaggacccagctgccccccgcctacaccaactccttcacaagaggcgtgtattaccccgataaggtcttcagatccagcgtcctccacagcacccaagatttgtttctgcctttcttcagcaacgtgacatggttccacgccattcatgtcagcggcacaaacggcacaaagaggtttgacaaccccgtgctccccttcaacgacggcgtgtacttcgccagcacagagaaatccaatatcattaggggctggatcttcggcacaacactggattccaagacccagtctctgctcattgtgaataacgccaccaacgtggtgattaaggtctgtgagtttcagttctgcaacgacccctttctgggagtctactaccacaagaataataagagctggatggagtccgagtttagggtgtacagctccgccaacaactgtaccttcgaatacgtgtcccagcctttcctcatggatctggagggcaagcaaggcaatttcaaaaatctgagagagttcgtgttcaaaaacattgatggatacttcaaaatctacagcaagcatacccccattaatctggtgagggatctgccccaaggattctccgctctggaacctctggtggatctgcccattggcattaacatcacaagattccagaccctcctcgccctccatagatcctatctgacccccggcgactcctccagcggatggacagccggagctgccgcctactacgtgggctatctgcagccaagaacctttctgctgaagtacaacgagaacggcaccatcacagacgctgtcgattgcgctctcgaccctctgagcgagaccaaatgcacactgaagagcttcaccgtggaaaagggcatctatcagaccagcaacttcagagtgcagcctaccgagagcattgtgaggtttcccaacatcaccaatctgtgtcctttcggcgaggtctttaatgccacaaggttcgcttccgtgtatgcttggaataggaagaggatcagcaattgcgtcgccgactattccgtcctctataacagcgcctccttctccaccttcaaatgttatggcgtgtcccccaccaagctcaacgacctctgcttcaccaatgtgtacgctgactccttcgtcattaggggcgacgaggtgaggcaaattgcccccggccagaccggcaagattgctgattacaactacaaactgcccgacgattttaccggctgcgtgatcgcttggaactccaacaatctggactccaaagtgggcggaaactacaattacctctacagactctttagaaaaagcaatctgaagcccttcgagagagacatctccaccgaaatctaccaagccggaagcacaccttgcaatggcgtcgagggatttaactgctacttccctctgcagagctacggctttcaacctaccaacggcgtcggatatcaaccctatagggtggtcgtgctgagctttgaactgctgcatgctcccgccaccgtctgcggacctaagaagagcaccaatctcgtcaaaaacaagtgcgtgaacttcaacttcaatggactgaccggcaccggcgtgctgaccgagagcaataagaagtttctgcccttccagcagttcggaagggatattgccgataccacagatgctgtgagggacccccaaaccctcgagattctggatatcaccccttgcagcttcggaggagtgtccgtgatcacccccggaacaaacacctccaatcaagtggctgtgctgtaccaagacgtgaactgcacagaagtccccgtggccatccatgccgaccagctgacccctacatggagagtgtactccaccggcagcaatgtgttccagacaagagccggatgcctcattggagctgaacacgtcaacaacagctacgagtgcgacattcccatcggcgccggcatttgtgcctcctatcagacccagaccaacagcccaagaagggctagaagcgtcgcttcccaatccatcattgcctacaccatgtctctgggagccgaaaactccgtcgcctactccaacaatagcatcgccatccccaccaattttaccatctccgtgaccacagagattctgcccgtgtccatgacaaagacatccgtggactgcaccatgtacatctgtggcgacagcaccgagtgtagcaatctgctgctgcaatatggcagcttctgcacccagctgaacagagccctcaccggcatcgccgtcgaacaagacaagaacacccaagaggtgttcgcccaagtgaagcaaatctacaagaccccccctatcaaagatttcggaggattcaactttagccagattctgcccgatcctagcaagccttccaagaggagcttcatcgaggatctgctgtttaataaggtgacactggccgacgctggcttcattaaacagtacggcgattgtctgggcgacatcgctgctagggatctgatctgcgctcagaagttcaacggactgacagtcctccctcctctgctgaccgacgagatgatcgctcagtataccagcgctctgctggctggaaccattaccagcggctggacattcggcgctggagccgccctccaaattccctttgccatgcagatggcctatagattcaacggcattggcgtcacccaaaatgtgctgtatgaaaatcagaagctgattgctaaccaattcaatagcgccattggcaagatccaagactctctgagctccacagccagcgccctcggaaagctgcaagacgtggtgaatcaaaacgcccaagctctgaacacactggtgaaacagctcagcagcaactttggagccatcagcagcgtgctcaatgatatcctctctaggctggaccctccggaggccgaagtccagatcgatagactcatcaccggcagactccaatctctgcagacatacgtcacccaacagctcattagagctgccgaaatcagagcctccgccaatctggccgccaccaagatgtccgagtgcgtgctgggacagagcaagagagtggacttctgtggcaagggataccatctgatgagcttcccccagagcgctccccatggagtggtctttctgcatgtcacatacgtgcccgcccaagagaagaacttcaccaccgctcccgccatttgccacgatggaaaggcccactttcccagagaaggagtgttcgtgagcaacggcacacactggtttgtcacccagagaaatttttacgagccccagattatcaccaccgacaacaccttcgtgtccggaaactgcgatgtcgtgattggcatcgtgaacaacacagtctacgaccctctgcagcccgaactcgacagcttcaaggaagagctggacaagtacttcaagaatcacacatcccccgacgtggatctgggcgacattagcggcattaatgcctccgtcgtcaacattcagaaggagattgatagactgaatgaagtcgccaagaacctcaatgagtctctgattgatctgcaagagctgggcaagtacgagcaatacatcaaatggccttggtacatctggctgggattcatcgctggactcatcgccatcgtgatggtcaccattatgctgtgttgcatgaccagctgctgcagctgtctgaagggctgctgcagctgcggaagctgctgcaagtttgacgaagacgactccgagcccgtgctgaagggcgtcaagctgcattatacataaactagtgctggaattcgcccttatagagtgctggaattcgcccttatagagtgctggaattcgcccttatatctagtaacggccgccagtgtgctggaattcgcccttataacttcgtatagcatacattatacgaagttataagggcgaattctgcagatatccatcctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacaacgtgtttatttttcaattgcagaaagaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcanggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacccctgaaaaaccctcctgcccctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatggcgat

SEQ ID NO: 34 - DNA, 36205 bp, Artificial
  nucleic acid sequence of SC-Ad-FZF-C68-(delta)IIIF-(delta)E3-Spike-3X-L
  misc_feature (7190)..(7190): n is a, c, g, or t
  misc_feature (21571)..(21571): n is a, c, g, or t
  misc_feature (24507)..(24507): n is a, c, g, or t
  misc_feature (34795)..(34795): n is a, c, g, or t
cgccatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccataaagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctancatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagtcgcggccgcgatatcgctagcgaagttcctattctctagaaagtataggaacttcggatcctctagagtcgaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgttatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcgccggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgggtccctgcgccgcgccgccagcggtccgcgatcgttgcggcccgtagccagtggcaactggcaaagcacactgaacagcatcgtgggtctgggggtgcaatccctgaagcgccgacgatgcttctgatcgcggccgcgatatcgctagcgaagttcctattctctagaaagtataggaacttctcgagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgagaattcgaagttcctattctctagaaagtataggaacttctcgagcacgggatcctctagagtcgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatggacatataaagccgatggtgaaactgccacagaaaaaacccacgtatttgggcaggcgccttattctggtataaatattacaaaagatggtattcaacttggaactgacaccgatgatcagccaatctacgcagataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaagcaaatgtgaaaacaggaacaggcactactaaagaatatgacatagacatgcaatttttcgacaacagaagtgcggctgctgctggcctagctccagaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattagaacagatacttatcagggaattaaggctaatggaactgatcaaaccacatggaccaaagatgacagtgtcaatgatgctaatgaggaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcanatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttntgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgacagatctgagctcgcggccgcgatatcgctagcgaagttcctattctctagaaagtataggaacttcgatcctctagagtcgacctgcaggcatgcaagcttggcactgcaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattcgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccaccatgtttgtctttctcgtgctgctgcccctcgtgagcagccagtgcgtcaatctgacaacaaggacccagctgccccccgcctacaccaactccttcacaagaggcgtgtattaccccgataaggtcttcagatccagcgtcctccacagcacccaagatttgtttctgcctttcttcagcaacgtgacatggttccacgccattcatgtcagcggcacaaacggcacaaagaggtttgacaaccccgtgctccccttcaacgacggcgtgtacttcgccagcacagagaaatccaatatcattaggggctggatcttcggcacaacactggattccaagacccagtctctgctcattgtgaataacgccaccaacgtggtgattaaggtctgtgagtttcagttctgcaacgacccctttctgggagtctactaccacaagaataataagagctggatggagtccgagtttagggtgtacagctccgccaacaactgtaccttcgaatacgtgtcccagcctttcctcatggatctggagggcaagcaaggcaatttcaaaaatctgagagagttcgtgttcaaaaacattgatggatacttcaaaatctacagcaagcatacccccattaatctggtgagggatctgccccaaggattctccgctctggaacctctggtggatctgcccattggcattaacatcacaagattccagaccctcctcgccctccatagatcctatctgacccccggcgactcctccagcggatggacagccggagctgccgcctactacgtgggctatctgcagccaagaacctttctgctgaagtacaacgagaacggcaccatcacagacgctgtcgattgcgctctcgaccctctgagcgagaccaaatgcacactgaagagcttcaccgtggaaaagggcatctatcagaccagcaacttcagagtgcagcctaccgagagcattgtgaggtttcccaacatcaccaatctgtgtcctttcggcgaggtctttaatgccacaaggttcgcttccgtgtatgcttggaataggaagaggatcagcaattgcgtcgccgactattccgtcctctataacagcgcctccttctccaccttcaaatgttatggcgtgtcccccaccaagctcaacgacctctgcttcaccaatgtgtacgctgactccttcgtcattaggggcgacgaggtgaggcaaattgcccccggccagaccggcaagattgctgattacaactacaaactgcccgacgattttaccggctgcgtgatcgcttggaactccaacaatctggactccaaagtgggcggaaactacaattacctctacagactctttagaaaaagcaatctgaagcccttcgagagagacatctccaccgaaatctaccaagccggaagcacaccttgcaatggcgtcgagggatttaactgctacttccctctgcagagctacggctttcaacctaccaacggcgtcggatatcaaccctatagggtggtcgtgctgagctttgaactgctgcatgctcccgccaccgtctgcggacctaagaagagcaccaatctcgtcaaaaacaagtgcgtgaacttcaacttcaatggactgaccggcaccggcgtgctgaccgagagcaataagaagtttctgcccttccagcagttcggaagggatattgccgataccacagatgctgtgagggacccccaaaccctcgagattctggatatcaccccttgcagcttcggaggagtgtccgtgatcacccccggaacaaacacctccaatcaagtggctgtgctgtaccaagacgtgaactgcacagaagtccccgtggccatccatgccgaccagctgacccctacatggagagtgtactccaccggcagcaatgtgttccagacaagagccggatgcctcattggagctgaacacgtcaacaacagctacgagtgcgacattcccatcggcgccggcatttgtgcctcctatcagacccagaccaacagcccaagaagggctagaagcgtcgcttcccaatccatcattgcctacaccatgtctctgggagccgaaaactccgtcgcctactccaacaatagcatcgccatccccaccaattttaccatctccgtgaccacagagattctgcccgtgtccatgacaaagacatccgtggactgcaccatgtacatctgtggcgacagcaccgagtgtagcaatctgctgctgcaatatggcagcttctgcacccagctgaacagagccctcaccggcatcgccgtcgaacaagacaagaacacccaagaggtgttcgcccaagtgaagcaaatctacaagaccccccctatcaaagatttcggaggattcaactttagccagattctgcccgatcctagcaagccttccaagaggagcttcatcgaggatctgctgtttaataaggtgacactggccgacgctggcttcattaaacagtacggcgattgtctgggcgacatcgctgctagggatctgatctgcgctcagaagttcaacggactgacagtcctccctcctctgctgaccgacgagatgatcgctcagtataccagcgctctgctggctggaaccattaccagcggctggacattcggcgctggagccgccctccaaattccctttgccatgcagatggcctatagattcaacggcattggcgtcacccaaaatgtgctgtatgaaaatcagaagctgattgctaaccaattcaatagcgccattggcaagatccaagactctctgagctccacagccagcgccctcggaaagctgcaagacgtggtgaatcaaaacgcccaagctctgaacacactggtgaaacagctcagcagcaactttggagccatcagcagcgtgctcaatgatatcctctctaggctggacaaagtggaggccgaagtccagatcgatagactcatcaccggcagactccaatctctgcagacatacgtcacccaacagctcattagagctgccgaaatcagagcctccgccaatctggccgccaccaagatgtccgagtgcgtgctgggacagagcaagagagtggacttctgtggcaagggataccatctgatgagcttcccccagagcgctccccatggagtggtctttctgcatgtcacatacgtgcccgcccaagagaagaacttcaccaccgctcccgccatttgccacgatggaaaggcccactttcccagagaaggagtgttcgtgagcaacggcacacactggtttgtcacccagagaaatttttacgagccccagattatcaccaccgacaacaccttcgtgtccggaaactgcgatgtcgtgattggcatcgtgaacaacacagtctacgaccctctgcagcccgaactcgacagcttcaaggaagagctggacaagtacttcaagaatcacacatcccccgacgtggatctgggcgacattagcggcattaatgcctccgtcgtcaacattcagaaggagattgatagactgaatgaagtcgccaagaacctcaatgagtctctgattgatctgcaagagctgggcaagtacgagcaatacatcaaatggccttggtacatctggctgggattcatcgctggactcatcgccatcgtgatggtcaccattatgctgtgttgcatgaccagctgctgcagctgtctgaagggctgctgcagctgcggaagctgctgcaagtttgacgaagacgactccgagcccgtgctgaagggcgtcaagctgcattatacataaactagtgctggaattcgcccttatagagtgctggaattcgcccttatagagtgctggaattcgcccttatatctagtaacggccgccagtgtgctggaattcgcccttataacttcgtatagcatacattatacgaagttataagggcgaattctgcagatatccatcctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacaacgtgtttatttttcaattgcagaaagaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcanggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacccctgaaaaaccctcctgcccctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatggcgat

SEQ ID NO: 35 - DNA, 36205 bp, Artificial
  nucleic acid sequence of SC-Ad-FZF-C68-(delta)IIIF-(delta)E3-SpikePP-3X-L
  misc_feature (7190)..(7190): n is a, c, g, or t
  misc_feature (21571)..(21571): n is a, c, g, or t
  misc_feature (24507)..(24507): n is a, c, g, or t
  misc_feature (34795)..(34795): n is a, c, g, or t
cgccatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccataaagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctancatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagtcgcggccgcgatatcgctagcgaagttcctattctctagaaagtataggaacttcggatcctctagagtcgaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgttatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcgccggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgggtccctgcgccgcgccgccagcggtccgcgatcgttgcggcccgtagccagtggcaactggcaaagcacactgaacagcatcgtgggtctgggggtgcaatccctgaagcgccgacgatgcttctgatcgcggccgcgatatcgctagcgaagttcctattctctagaaagtataggaacttctcgagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgagaattcgaagttcctattctctagaaagtataggaacttctcgagcacgggatcctctagagtcgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatggacatataaagccgatggtgaaactgccacagaaaaaacccacgtatttgggcaggcgccttattctggtataaatattacaaaagatggtattcaacttggaactgacaccgatgatcagccaatctacgcagataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaagcaaatgtgaaaacaggaacaggcactactaaagaatatgacatagacatgcaatttttcgacaacagaagtgcggctgctgctggcctagctccagaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattagaacagatacttatcagggaattaaggctaatggaactgatcaaaccacatggaccaaagatgacagtgtcaatgatgctaatgaggaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcanatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttntgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgacagatctgagctcgcggccgcgatatcgctagcgaagttcctattctctagaaagtataggaacttcgatcctctagagtcgacctgcaggcatgcaagcttggcactgcaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattcgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccaccatgtttgtctttctcgtgctgctgcccctcgtgagcagccagtgcgtcaatctgacaacaaggacccagctgccccccgcctacaccaactccttcacaagaggcgtgtattaccccgataaggtcttcagatccagcgtcctccacagcacccaagatttgtttctgcctttcttcagcaacgtgacatggttccacgccattcatgtcagcggcacaaacggcacaaagaggtttgacaaccccgtgctccccttcaacgacggcgtgtacttcgccagcacagagaaatccaatatcattaggggctggatcttcggcacaacactggattccaagacccagtctctgctcattgtgaataacgccaccaacgtggtgattaaggtctgtgagtttcagttctgcaacgacccctttctgggagtctactaccacaagaataataagagctggatggagtccgagtttagggtgtacagctccgccaacaactgtaccttcgaatacgtgtcccagcctttcctcatggatctggagggcaagcaaggcaatttcaaaaatctgagagagttcgtgttcaaaaacattgatggatacttcaaaatctacagcaagcatacccccattaatctggtgagggatctgccccaaggattctccgctctggaacctctggtggatctgcccattggcattaacatcacaagattccagaccctcctcgccctccatagatcctatctgacccccggcgactcctccagcggatggacagccggagctgccgcctactacgtgggctatctgcagccaagaacctttctgctgaagtacaacgagaacggcaccatcacagacgctgtcgattgcgctctcgaccctctgagcgagaccaaatgcacactgaagagcttcaccgtggaaaagggcatctatcagaccagcaacttcagagtgcagcctaccgagagcattgtgaggtttcccaacatcaccaatctgtgtcctttcggcgaggtctttaatgccacaaggttcgcttccgtgtatgcttggaataggaagaggatcagcaattgcgtcgccgactattccgtcctctataacagcgcctccttctccaccttcaaatgttatggcgtgtcccccaccaagctcaacgacctctgcttcaccaatgtgtacgctgactccttcgtcattaggggcgacgaggtgaggcaaattgcccccggccagaccggcaagattgctgattacaactacaaactgcccgacgattttaccggctgcgtgatcgcttggaactccaacaatctggactccaaagtgggcggaaactacaattacctctacagactctttagaaaaagcaatctgaagcccttcgagagagacatctccaccgaaatctaccaagccggaagcacaccttgcaatggcgtcgagggatttaactgctacttccctctgcagagctacggctttcaacctaccaacggcgtcggatatcaaccctatagggtggtcgtgctgagctttgaactgctgcatgctcccgccaccgtctgcggacctaagaagagcaccaatctcgtcaaaaacaagtgcgtgaacttcaacttcaatggactgaccggcaccggcgtgctgaccgagagcaataagaagtttctgcccttccagcagttcggaagggatattgccgataccacagatgctgtgagggacccccaaaccctcgagattctggatatcaccccttgcagcttcggaggagtgtccgtgatcacccccggaacaaacacctccaatcaagtggctgtgctgtaccaagacgtgaactgcacagaagtccccgtggccatccatgccgaccagctgacccctacatggagagtgtactccaccggcagcaatgtgttccagacaagagccggatgcctcattggagctgaacacgtcaacaacagctacgagtgcgacattcccatcggcgccggcatttgtgcctcctatcagacccagaccaacagcccaagaagggctagaagcgtcgcttcccaatccatcattgcctacaccatgtctctgggagccgaaaactccgtcgcctactccaacaatagcatcgccatccccaccaattttaccatctccgtgaccacagagattctgcccgtgtccatgacaaagacatccgtggactgcaccatgtacatctgtggcgacagcaccgagtgtagcaatctgctgctgcaatatggcagcttctgcacccagctgaacagagccctcaccggcatcgccgtcgaacaagacaagaacacccaagaggtgttcgcccaagtgaagcaaatctacaagaccccccctatcaaagatttcggaggattcaactttagccagattctgcccgatcctagcaagccttccaagaggagcttcatcgaggatctgctgtttaataaggtgacactggccgacgctggcttcattaaacagtacggcgattgtctgggcgacatcgctgctagggatctgatctgcgctcagaagttcaacggactgacagtcctccctcctctgctgaccgacgagatgatcgctcagtataccagcgctctgctggctggaaccattaccagcggctggacattcggcgctggagccgccctccaaattccctttgccatgcagatggcctatagattcaacggcattggcgtcacccaaaatgtgctgtatgaaaatcagaagctgattgctaaccaattcaatagcgccattggcaagatccaagactctctgagctccacagccagcgccctcggaaagctgcaagacgtggtgaatcaaaacgcccaagctctgaacacactggtgaaacagctcagcagcaactttggagccatcagcagcgtgctcaatgatatcctctctaggctggaccctccggaggccgaagtccagatcgatagactcatcaccggcagactccaatctctgcagacatacgtcacccaacagctcattagagctgccgaaatcagagcctccgccaatctggccgccaccaagatgtccgagtgcgtgctgggacagagcaagagagtggacttctgtggcaagggataccatctgatgagcttcccccagagcgctccccatggagtggtctttctgcatgtcacatacgtgcccgcccaagagaagaacttcaccaccgctcccgccatttgccacgatggaaaggcccactttcccagagaaggagtgttcgtgagcaacggcacacactggtttgtcacccagagaaatttttacgagccccagattatcaccaccgacaacaccttcgtgtccggaaactgcgatgtcgtgattggcatcgtgaacaacacagtctacgaccctctgcagcccgaactcgacagcttcaaggaagagctggacaagtacttcaagaatcacacatcccccgacgtggatctgggcgacattagcggcattaatgcctccgtcgtcaacattcagaaggagattgatagactgaatgaagtcgccaagaacctcaatgagtctctgattgatctgcaagagctgggcaagtacgagcaatacatcaaatggccttggtacatctggctgggattcatcgctggactcatcgccatcgtgatggtcaccattatgctgtgttgcatgaccagctgctgcagctgtctgaagggctgctgcagctgcggaagctgctgcaagtttgacgaagacgactccgagcccgtgctgaagggcgtcaagctgcattatacataaactagtgctggaattcgcccttatagagtgctggaattcgcccttatagagtgctggaattcgcccttatatctagtaacggccgccagtgtgctggaattcgcccttataacttcgtatagcatacattatacgaagttataagggcgaattctgcagatatccatcctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacaacgtgtttatttttcaattgcagaaagaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcanggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacccctgaaaaaccctcctgcccctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatggcgat

SEQ ID NO: 36 - DNA, 35792 bp, Artificial
  nucleic acid sequence of SC-Ad-F-657-(delta)IIIF-(delta)E3-Spike-3X-L
  misc_feature (7190)..(7190): n is a, c, g, or t
  misc_feature (21158)..(21158): n is a, c, g, or t
  misc_feature (24094)..(24094): n is a, c, g, or t
  misc_feature (34382)..(34382): n is a, c, g, or t
cgccatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccataaagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctancatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagtcgcggccgcgatatcgctagcgaagttcctattctctagaaagtataggaacttcggatcctctagagtcgaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgttatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcgccggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgggtccctgcgccgcgccgccagcggtccgcgatcgttgcggcccgtagccagtggcaactggcaaagcacactgaacagcatcgtgggtctgggggtgcaatccctgaagcgccgacgatgcttctgatcgcggccgcgatatcgctagcgaattcgaagttcctattctctagaaagtataggaacttcggatcctctagagtcgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccccacttttaagccctactccggcactgcctacaacgccctagctcccaagggtgcccccaactcatgcgagtgggatgaagatgatactcaggtacaggtagcggctgaagacgatcaagacgacgacgaagaagaggaacaactacctcagcagagaaatggcaaaaaaactcacgtatatgctcaggcaccgtttgctggcgaagcaattaacaaaaacggcctgcagataggaactaacggtgcagccactgaaggaaataaggaaatttacgcagataaaacttatcaacctgaaccacaaataggagaatcacagtggaacgaagccgaatcgtccgtagcaggtggaagggttcttaaaaagactactcccatgaaaccatgctatggctcctatgccagacctaccaattctaacggaggtcagggcgttatggttgaacaaaatggtaaattggaaagtcaagtagaaatgcaatttttttcaacttctgtaaatgctatgaacgaggcaaacgctattcaacctaaactagtgttgtatagtgaagatgtaaatatggaaaccccagacactcatctttcttataagcctggaaaaagtgatgataattctaaggcaatgttgggtcaacaatctatgccaaacagacccaattacatagctttcagggacaattttattggcctaatgtattacaacagcactggtaacatgggtgttcttgctggtcaggcatcacagctaaatgctgtcgtagatttgcaagacagaaacacagagctgtcctaccaacttttgcttgattctattggtgatcgaaccagatacttttccatgtggaatcaggctgtagacagctacgatccagatgttagaattatcgagaaccatggaactgaggatgaattgccaaattattgttttcctcttggcggaattggggtgacggacacctatcaagctattaaggctacaaatggaaatggaggcgccactacctgggctcaggacaatacttttgcagaacgaaatgaaataggggtgggaaataactttgccatggaaattaacctgaatgccaacctatggagaaatttcctttactccaatattgcgctgtacctgccagacaagctaaaatacaaccccaccaatgtggaaatatctgacaatcccaacacctacgactacatgaacaagcgagtggtggctcccgggctggtggattgctacattaaccttggggcgcgctggtctctggactacatggacaacgttaatccctttaaccaccaccgcaatgcgggcctgcgttaccgctccatgttgttgggaaacggccgctacgtgccctttcacattcaggtgccccaaaagttttttgccattaaaaacctcctcctcctgccaggctcatacacatatgaatggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcanatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttntgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgacagatctgagctcgcggccgcgatatcgctagcgaagttcctattctctagaaagtataggaacttcgatcctctagagtcgacctgcaggcatgcaagcttggcactgcaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattcgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccaccatgtttgtctttctcgtgctgctgcccctcgtgagcagccagtgcgtcaatctgacaacaaggacccagctgccccccgcctacaccaactccttcacaagaggcgtgtattaccccgataaggtcttcagatccagcgtcctccacagcacccaagatttgtttctgcctttcttcagcaacgtgacatggttccacgccattcatgtcagcggcacaaacggcacaaagaggtttgacaaccccgtgctccccttcaacgacggcgtgtacttcgccagcacagagaaatccaatatcattaggggctggatcttcggcacaacactggattccaagacccagtctctgctcattgtgaataacgccaccaacgtggtgattaaggtctgtgagtttcagttctgcaacgacccctttctgggagtctactaccacaagaataataagagctggatggagtccgagtttagggtgtacagctccgccaacaactgtaccttcgaatacgtgtcccagcctttcctcatggatctggagggcaagcaaggcaatttcaaaaatctgagagagttcgtgttcaaaaacattgatggatacttcaaaatctacagcaagcatacccccattaatctggtgagggatctgccccaaggattctccgctctggaacctctggtggatctgcccattggcattaacatcacaagattccagaccctcctcgccctccatagatcctatctgacccccggcgactcctccagcggatggacagccggagctgccgcctactacgtgggctatctgcagccaagaacctttctgctgaagtacaacgagaacggcaccatcacagacgctgtcgattgcgctctcgaccctctgagcgagaccaaatgcacactgaagagcttcaccgtggaaaagggcatctatcagaccagcaacttcagagtgcagcctaccgagagcattgtgaggtttcccaacatcaccaatctgtgtcctttcggcgaggtctttaatgccacaaggttcgcttccgtgtatgcttggaataggaagaggatcagcaattgcgtcgccgactattccgtcctctataacagcgcctccttctccaccttcaaatgttatggcgtgtcccccaccaagctcaacgacctctgcttcaccaatgtgtacgctgactccttcgtcattaggggcgacgaggtgaggcaaattgcccccggccagaccggcaagattgctgattacaactacaaactgcccgacgattttaccggctgcgtgatcgcttggaactccaacaatctggactccaaagtgggcggaaactacaattacctctacagactctttagaaaaagcaatctgaagcccttcgagagagacatctccaccgaaatctaccaagccggaagcacaccttgcaatggcgtcgagggatttaactgctacttccctctgcagagctacggctttcaacctaccaacggcgtcggatatcaaccctatagggtggtcgtgctgagctttgaactgctgcatgctcccgccaccgtctgcggacctaagaagagcaccaatctcgtcaaaaacaagtgcgtgaacttcaacttcaatggactgaccggcaccggcgtgctgaccgagagcaataagaagtttctgcccttccagcagttcggaagggatattgccgataccacagatgctgtgagggacccccaaaccctcgagattctggatatcaccccttgcagcttcggaggagtgtccgtgatcacccccggaacaaacacctccaatcaagtggctgtgctgtaccaagacgtgaactgcacagaagtccccgtggccatccatgccgaccagctgacccctacatggagagtgtactccaccggcagcaatgtgttccagacaagagccggatgcctcattggagctgaacacgtcaacaacagctacgagtgcgacattcccatcggcgccggcatttgtgcctcctatcagacccagaccaacagcccaagaagggctagaagcgtcgcttcccaatccatcattgcctacaccatgtctctgggagccgaaaactccgtcgcctactccaacaatagcatcgccatccccaccaattttaccatctccgtgaccacagagattctgcccgtgtccatgacaaagacatccgtggactgcaccatgtacatctgtggcgacagcaccgagtgtagcaatctgctgctgcaatatggcagcttctgcacccagctgaacagagccctcaccggcatcgccgtcgaacaagacaagaacacccaagaggtgttcgcccaagtgaagcaaatctacaagaccccccctatcaaagatttcggaggattcaactttagccagattctgcccgatcctagcaagccttccaagaggagcttcatcgaggatctgctgtttaataaggtgacactggccgacgctggcttcattaaacagtacggcgattgtctgggcgacatcgctgctagggatctgatctgcgctcagaagttcaacggactgacagtcctccctcctctgctgaccgacgagatgatcgctcagtataccagcgctctgctggctggaaccattaccagcggctggacattcggcgctggagccgccctccaaattccctttgccatgcagatggcctatagattcaacggcattggcgtcacccaaaatgtgctgtatgaaaatcagaagctgattgctaaccaattcaatagcgccattggcaagatccaagactctctgagctccacagccagcgccctcggaaagctgcaagacgtggtgaatcaaaacgcccaagctctgaacacactggtgaaacagctcagcagcaactttggagccatcagcagcgtgctcaatgatatcctctctaggctggacaaagtggaggccgaagtccagatcgatagactcatcaccggcagactccaatctctgcagacatacgtcacccaacagctcattagagctgccgaaatcagagcctccgccaatctggccgccaccaagatgtccgagtgcgtgctgggacagagcaagagagtggacttctgtggcaagggataccatctgatgagcttcccccagagcgctccccatggagtggtctttctgcatgtcacatacgtgcccgcccaagagaagaacttcaccaccgctcccgccatttgccacgatggaaaggcccactttcccagagaaggagtgttcgtgagcaacggcacacactggtttgtcacccagagaaatttttacgagccccagattatcaccaccgacaacaccttcgtgtccggaaactgcgatgtcgtgattggcatcgtgaacaacacagtctacgaccctctgcagcccgaactcgacagcttcaaggaagagctggacaagtacttcaagaatcacacatcccccgacgtggatctgggcgacattagcggcattaatgcctccgtcgtcaacattcagaaggagattgatagactgaatgaagtcgccaagaacctcaatgagtctctgattgatctgcaagagctgggcaagtacgagcaatacatcaaatggccttggtacatctggctgggattcatcgctggactcatcgccatcgtgatggtcaccattatgctgtgttgcatgaccagctgctgcagctgtctgaagggctgctgcagctgcggaagctgctgcaagtttgacgaagacgactccgagcccgtgctgaagggcgtcaagctgcattatacataaactagtgctggaattcgcccttatagagtgctggaattcgcccttatagagtgctggaattcgcccttatatctagtaacggccgccagtgtgctggaattcgcccttataacttcgtatagcatacattatacgaagttataagggcgaattctgcagatatccatcctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacaacgtgtttatttttcaattgcagaaagaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcanggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacccctgaaaaaccctcctgcccctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatggcgat

SEQ ID NO: 37 - DNA, 35792 bp, Artificial
  nucleic acid sequence of SC-Ad-F-657-(delta)IIIF-(delta)E3-SpikePP-3X-L
  misc_feature (7190)..(7190): n is a, c, g, or t
  misc_feature (21158)..(21158): n is a, c, g, or t
  misc_feature (24094)..(24094): n is a, c, g, or t
  misc_feature (34382)..(34382): n is a, c, g, or t
cgccatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccataaagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctancatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagtcgcggccgcgatatcgctagcgaagttcctattctctagaaagtataggaacttcggatcctctagagtcgaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgttatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcgccggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgggtccctgcgccgcgccgccagcggtccgcgatcgttgcggcccgtagccagtggcaactggcaaagcacactgaacagcatcgtgggtctgggggtgcaatccctgaagcgccgacgatgcttctgatcgcggccgcgatatcgctagcgaattcgaagttcctattctctagaaagtataggaacttcggatcctctagagtcgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccccacttttaagccctactccggcactgcctacaacgccctagctcccaagggtgcccccaactcatgcgagtgggatgaagatgatactcaggtacaggtagcggctgaagacgatcaagacgacgacgaagaagaggaacaactacctcagcagagaaatggcaaaaaaactcacgtatatgctcaggcaccgtttgctggcgaagcaattaacaaaaacggcctgcagataggaactaacggtgcagccactgaaggaaataaggaaatttacgcagataaaacttatcaacctgaaccacaaataggagaatcacagtggaacgaagccgaatcgtccgtagcaggtggaagggttcttaaaaagactactcccatgaaaccatgctatggctcctatgccagacctaccaattctaacggaggtcagggcgttatggttgaacaaaatggtaaattggaaagtcaagtagaaatgcaatttttttcaacttctgtaaatgctatgaacgaggcaaacgctattcaacctaaactagtgttgtatagtgaagatgtaaatatggaaaccccagacactcatctttcttataagcctggaaaaagtgatgataattctaaggcaatgttgggtcaacaatctatgccaaacagacccaattacatagctttcagggacaattttattggcctaatgtattacaacagcactggtaacatgggtgttcttgctggtcaggcatcacagctaaatgctgtcgtagatttgcaagacagaaacacagagctgtcctaccaacttttgcttgattctattggtgatcgaaccagatacttttccatgtggaatcaggctgtagacagctacgatccagatgttagaattatcgagaaccatggaactgaggatgaattgccaaattattgttttcctcttggcggaattggggtgacggacacctatcaagctattaaggctacaaatggaaatggaggcgccactacctgggctcaggacaatacttttgcagaacgaaatgaaataggggtgggaaataactttgccatggaaattaacctgaatgccaacctatggagaaatttcctttactccaatattgcgctgtacctgccagacaagctaaaatacaaccccaccaatgtggaaatatctgacaatcccaacacctacgactacatgaacaagcgagtggtggctcccgggctggtggattgctacattaaccttggggcgcgctggtctctggactacatggacaacgttaatccctttaaccaccaccgcaatgcgggcctgcgttaccgctccatgttgttgggaaacggccgctacgtgccctttcacattcaggtgccccaaaagttttttgccattaaaaacctcctcctcctgccaggctcatacacatatgaatggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcanatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttntgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgacagatctgagctcgcggccgcgatatcgctagcgaagttcctattctctagaaagtataggaacttcgatcctctagagtcgacctgcaggcatgcaagcttggcactgcaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattcgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccaccatgtttgtctttctcgtgctgctgcccctcgtgagcagccagtgcgtcaatctgacaacaaggacccagctgccccccgcctacaccaactccttcacaagaggcgtgtattaccccgataaggtcttcagatccagcgtcctccacagcacccaagatttgtttctgcctttcttcagcaacgtgacatggttccacgccattcatgtcagcggcacaaacggcacaaagaggtttgacaaccccgtgctccccttcaacgacggcgtgtacttcgccagcacagagaaatccaatatcattaggggctggatcttcggcacaacactggattccaagacccagtctctgctcattgtgaataacgccaccaacgtggtgattaaggtctgtgagtttcagttctgcaacgacccctttctgggagtctactaccacaagaataataagagctggatggagtccgagtttagggtgtacagctccgccaacaactgtaccttcgaatacgtgtcccagcctttcctcatggatctggagggcaagcaaggcaatttcaaaaatctgagagagttcgtgttcaaaaacattgatggatacttcaaaatctacagcaagcatacccccattaatctggtgagggatctgccccaaggattctccgctctggaacctctggtggatctgcccattggcattaacatcacaagattccagaccctcctcgccctccatagatcctatctgacccccggcgactcctccagcggatggacagccggagctgccgcctactacgtgggctatctgcagccaagaacctttctgctgaagtacaacgagaacggcaccatcacagacgctgtcgattgcgctctcgaccctctgagcgagaccaaatgcacactgaagagcttcaccgtggaaaagggcatctatcagaccagcaacttcagagtgcagcctaccgagagcattgtgaggtttcccaacatcaccaatctgtgtcctttcggcgaggtctttaatgccacaaggttcgcttccgtgtatgcttggaataggaagaggatcagcaattgcgtcgccgactattccgtcctctataacagcgcctccttctccaccttcaaatgttatggcgtgtcccccaccaagctcaacgacctctgcttcaccaatgtgtacgctgactccttcgtcattaggggcgacgaggtgaggcaaattgcccccggccagaccggcaagattgctgattacaactacaaactgcccgacgattttaccggctgcgtgatcgcttggaactccaacaatctggactccaaagtgggcggaaactacaattacctctacagactctttagaaaaagcaatctgaagcccttcgagagagacatctccaccgaaatctaccaagccggaagcacaccttgcaatggcgtcgagggatttaactgctacttccctctgcagagctacggctttcaacctaccaacggcgtcggatatcaaccctatagggtggtcgtgctgagctttgaactgctgcatgctcccgccaccgtctgcggacctaagaagagcaccaatctcgtcaaaaacaagtgcgtgaacttcaacttcaatggactgaccggcaccggcgtgctgaccgagagcaataagaagtttctgcccttccagcagttcggaagggatattgccgataccacagatgctgtgagggacccccaaaccctcgagattctggatatcaccccttgcagcttcggaggagtgtccgtgatcacccccggaacaaacacctccaatcaagtggctgtgctgtaccaagacgtgaactgcacagaagtccccgtggccatccatgccgaccagctgacccctacatggagagtgtactccaccggcagcaatgtgttccagacaagagccggatgcctcattggagctgaacacgtcaacaacagctacgagtgcgacattcccatcggcgccggcatttgtgcctcctatcagacccagaccaacagcccaagaagggctagaagcgtcgcttcccaatccatcattgcctacaccatgtctctgggagccgaaaactccgtcgcctactccaacaatagcatcgccatccccaccaattttaccatctccgtgaccacagagattctgcccgtgtccatgacaaagacatccgtggactgcaccatgtacatctgtggcgacagcaccgagtgtagcaatctgctgctgcaatatggcagcttctgcacccagctgaacagagccctcaccggcatcgccgtcgaacaagacaagaacacccaagaggtgttcgcccaagtgaagcaaatctacaagaccccccctatcaaagatttcggaggattcaactttagccagattctgcccgatcctagcaagccttccaagaggagcttcatcgaggatctgctgtttaataaggtgacactggccgacgctggcttcattaaacagtacggcgattgtctgggcgacatcgctgctagggatctgatctgcgctcagaagttcaacggactgacagtcctccctcctctgctgaccgacgagatgatcgctcagtataccagcgctctgctggctggaaccattaccagcggctggacattcggcgctggagccgccctccaaattccctttgccatgcagatggcctatagattcaacggcattggcgtcacccaaaatgtgctgtatgaaaatcagaagctgattgctaaccaattcaatagcgccattggcaagatccaagactctctgagctccacagccagcgccctcggaaagctgcaagacgtggtgaatcaaaacgcccaagctctgaacacactggtgaaacagctcagcagcaactttggagccatcagcagcgtgctcaatgatatcctctctaggctggaccctccggaggccgaagtccagatcgatagactcatcaccggcagactccaatctctgcagacatacgtcacccaacagctcattagagctgccgaaatcagagcctccgccaatctggccgccaccaagatgtccgagtgcgtgctgggacagagcaagagagtggacttctgtggcaagggataccatctgatgagcttcccccagagcgctccccatggagtggtctttctgcatgtcacatacgtgcccgcccaagagaagaacttcaccaccgctcccgccatttgccacgatggaaaggcccactttcccagagaaggagtgttcgtgagcaacggcacacactggtttgtcacccagagaaatttttacgagccccagattatcaccaccgacaacaccttcgtgtccggaaactgcgatgtcgtgattggcatcgtgaacaacacagtctacgaccctctgcagcccgaactcgacagcttcaaggaagagctggacaagtacttcaagaatcacacatcccccgacgtggatctgggcgacattagcggcattaatgcctccgtcgtcaacattcagaaggagattgatagactgaatgaagtcgccaagaacctcaatgagtctctgattgatctgcaagagctgggcaagtacgagcaatacatcaaatggccttggtacatctggctgggattcatcgctggactcatcgccatcgtgatggtcaccattatgctgtgttgcatgaccagctgctgcagctgtctgaagggctgctgcagctgcggaagctgctgcaagtttgacgaagacgactccgagcccgtgctgaagggcgtcaagctgcattatacataaactagtgctggaattcgcccttatagagtgctggaattcgcccttatagagtgctggaattcgcccttatatctagtaacggccgccagtgtgctggaattcgcccttataacttcgtatagcatacattatacgaagttataagggcgaattctgcagatatccatcctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacaacgtgtttatttttcaattgcagaaagaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcanggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacccctgaaaaaccctcctgcccctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatggcgat

SEQ ID NO: 38 - DNA, 35720 bp, Artificial
  nucleic acid sequence of SC-Ad-F-C68-(delta)IIIF-(delta)E3-Spike-3X-L
  misc_feature (7190)..(7190): n is a, c, g, or t
  misc_feature (21086)..(21086): n is a, c, g, or t
  misc_feature (24022)..(24022): n is a, c, g, or t
  misc_feature (34310)..(34310): n is a, c, g, or t
cgccatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccataaagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctancatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagtcgcggccgcgatatcgctagcgaagttcctattctctagaaagtataggaacttcggatcctctagagtcgaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgttatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcgccggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgggtccctgcgccgcgccgccagcggtccgcgatcgttgcggcccgtagccagtggcaactggcaaagcacactgaacagcatcgtgggtctgggggtgcaatccctgaagcgccgacgatgcttctgatcgcggccgcgatatcgctagcgaattcgaagttcctattctctagaaagtataggaacttctcgagcacgggatcctctagagtcgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatggacatataaagccgatggtgaaactgccacagaaaaaacccacgtatttgggcaggcgccttattctggtataaatattacaaaagatggtattcaacttggaactgacaccgatgatcagccaatctacgcagataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaagcaaatgtgaaaacaggaacaggcactactaaagaatatgacatagacatgcaatttttcgacaacagaagtgcggctgctgctggcctagctccagaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattagaacagatacttatcagggaattaaggctaatggaactgatcaaaccacatggaccaaagatgacagtgtcaatgatgctaatgaggaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcanatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttntgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgacagatctgagctcgcggccgcgatatcgctagcgaagttcctattctctagaaagtataggaacttcgatcctctagagtcgacctgcaggcatgcaagcttggcactgcaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattcgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccaccatgtttgtctttctcgtgctgctgcccctcgtgagcagccagtgcgtcaatctgacaacaaggacccagctgccccccgcctacaccaactccttcacaagaggcgtgtattaccccgataaggtcttcagatccagcgtcctccacagcacccaagatttgtttctgcctttcttcagcaacgtgacatggttccacgccattcatgtcagcggcacaaacggcacaaagaggtttgacaaccccgtgctccccttcaacgacggcgtgtacttcgccagcacagagaaatccaatatcattaggggctggatcttcggcacaacactggattccaagacccagtctctgctcattgtgaataacgccaccaacgtggtgattaaggtctgtgagtttcagttctgcaacgacccctttctgggagtctactaccacaagaataataagagctggatggagtccgagtttagggtgtacagctccgccaacaactgtaccttcgaatacgtgtcccagcctttcctcatggatctggagggcaagcaaggcaatttcaaaaatctgagagagttcgtgttcaaaaacattgatggatacttcaaaatctacagcaagcatacccccattaatctggtgagggatctgccccaaggattctccgctctggaacctctggtggatctgcccattggcattaacatcacaagattccagaccctcctcgccctccatagatcctatctgacccccggcgactcctccagcggatggacagccggagctgccgcctactacgtgggctatctgcagccaagaacctttctgctgaagtacaacgagaacggcaccatcacagacgctgtcgattgcgctctcgaccctctgagcgagaccaaatgcacactgaagagcttcaccgtggaaaagggcatctatcagaccagcaacttcagagtgcagcctaccgagagcattgtgaggtttcccaacatcaccaatctgtgtcctttcggcgaggtctttaatgccacaaggttcgcttccgtgtatgcttggaataggaagaggatcagcaattgcgtcgccgactattccgtcctctataacagcgcctccttctccaccttcaaatgttatggcgtgtcccccaccaagctcaacgacctctgcttcaccaatgtgtacgctgactccttcgtcattaggggcgacgaggtgaggcaaattgcccccggccagaccggcaagattgctgattacaactacaaactgcccgacgattttaccggctgcgtgatcgcttggaactccaacaatctggactccaaagtgggcggaaactacaattacctctacagactctttagaaaaagcaatctgaagcccttcgagagagacatctccaccgaaatctaccaagccggaagcacaccttgcaatggcgtcgagggatttaactgctacttccctctgcagagctacggctttcaacctaccaacggcgtcggatatcaaccctatagggtggtcgtgctgagctttgaactgctgcatgctcccgccaccgtctgcggacctaagaagagcaccaatctcgtcaaaaacaagtgcgtgaacttcaacttcaatggactgaccggcaccggcgtgctgaccgagagcaataagaagtttctgcccttccagcagttcggaagggatattgccgataccacagatgctgtgagggacccccaaaccctcgagattctggatatcaccccttgcagcttcggaggagtgtccgtgatcacccccggaacaaacacctccaatcaagtggctgtgctgtaccaagacgtgaactgcacagaagtccccgtggccatccatgccgaccagctgacccctacatggagagtgtactccaccggcagcaatgtgttccagacaagagccggatgcctcattggagctgaacacgtcaacaacagctacgagtgcgacattcccatcggcgccggcatttgtgcctcctatcagacccagaccaacagcccaagaagggctagaagcgtcgcttcccaatccatcattgcctacaccatgtctctgggagccgaaaactccgtcgcctactccaacaatagcatcgccatccccaccaattttaccatctccgtgaccacagagattctgcccgtgtccatgacaaagacatccgtggactgcaccatgtacatctgtggcgacagcaccgagtgtagcaatctgctgctgcaatatggcagcttctgcacccagctgaacagagccctcaccggcatcgccgtcgaacaagacaagaacacccaagaggtgttcgcccaagtgaagcaaatctacaagaccccccctatcaaagatttcggaggattcaactttagccagattctgcccgatcctagcaagccttccaagaggagcttcatcgaggatctgctgtttaataaggtgacactggccgacgctggcttcattaaacagtacggcgattgtctgggcgacatcgctgctagggatctgatctgcgctcagaagttcaacggactgacagtcctccctcctctgctgaccgacgagatgatcgctcagtataccagcgctctgctggctggaaccattaccagcggctggacattcggcgctggagccgccctccaaattccctttgccatgcagatggcctatagattcaacggcattggcgtcacccaaaatgtgctgtatgaaaatcagaagctgattgctaaccaattcaatagcgccattggcaagatccaagactctctgagctccacagccagcgccctcggaaagctgcaagacgtggtgaatcaaaacgcccaagctctgaacacactggtgaaacagctcagcagcaactttggagccatcagcagcgtgctcaatgatatcctctctaggctggacaaagtggaggccgaagtccagatcgatagactcatcaccggcagactccaatctctgcagacatacgtcacccaacagctcattagagctgccgaaatcagagcctccgccaatctggccgccaccaagatgtccgagtgcgtgctgggacagagcaagagagtggacttctgtggcaagggataccatctgatgagcttcccccagagcgctccccatggagtggtctttctgcatgtcacatacgtgcccgcccaagagaagaacttcaccaccgctcccgccatttgccacgatggaaaggcccactttcccagagaaggagtgttcgtgagcaacggcacacactggtttgtcacccagagaaatttttacgagccccagattatcaccaccgacaacaccttcgtgtccggaaactgcgatgtcgtgattggcatcgtgaacaacacagtctacgaccctctgcagcccgaactcgacagcttcaaggaagagctggacaagtacttcaagaatcacacatcccccgacgtggatctgggcgacattagcggcattaatgcctccgtcgtcaacattcagaaggagattgatagactgaatgaagtcgccaagaacctcaatgagtctctgattgatctgcaagagctgggcaagtacgagcaatacatcaaatggccttggtacatctggctgggattcatcgctggactcatcgccatcgtgatggtcaccattatgctgtgttgcatgaccagctgctgcagctgtctgaagggctgctgcagctgcggaagctgctgcaagtttgacgaagacgactccgagcccgtgctgaagggcgtcaagctgcattatacataaactagtgctggaattcgcccttatagagtgctggaattcgcccttatagagtgctggaattcgcccttatatctagtaacggccgccagtgtgctggaattcgcccttataacttcgtatagcatacattatacgaagttataagggcgaattctgcagatatccatcctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacaacgtgtttatttttcaattgcagaaagaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcanggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacccctgaaaaaccctcctgcccctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatggcgat

SEQ ID NO: 39 - DNA, 35720 bp, Artificial
  nucleic acid sequence of SC-Ad-F-C68-(delta)IIIF-(delta)E3-SpikePP-3X-L
  misc_feature (7190)..(7190): n is a, c, g, or t
  misc_feature (21086)..(21086): n is a, c, g, or t
  misc_feature (24022)..(24022): n is a, c, g, or t
  misc_feature (34310)..(34310): n is a, c, g, or t
cgccatcatcaataatataccttattttggattgaagccaatatgataatgagggggtggagtttgtgacgtggcgcggggcgtgggaacggggcgggtgacgtagtagtgtggcggaagtgtgatgttgtaagtgtggcggaacacatgtaagcgccggatgtggtaaaagtgacgtttttggtgtgcgccggtgtacacgggaagtgacaattttcgcgcggttttaggcggatgttgtagtaaatttgggcgtaaccaagtaatatttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaaattatgggcagtgggtgatagagtggtgggtttggtgtggtaattttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccataaagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgctttatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctaagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatccgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggttgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcactaggtgcacgcgccaaccgcggttgtgcagggtgacaaggtcaacgctggtggctacctctccgcgtaggcgctcgttggtccagcagaggcggccgcccttgcgcgagcagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctancatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccgcggctaggtctcgcgcggcggtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagccgggtcagggcgcgggctaggtccaggtgatacctgatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgccgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcgtccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactggtatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcacggacgcggttccagatgttgcgcagcggcaaaaagtgctccatggtcgggacgctctggccggtcaggcgcgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggatgctgcgctagcttttttggccactggccgcgcgcggcgtaagcggttaggctggaaagcgaaagcattaagtggctcgctccctgtagccggagggttattttccaagggttgagtcgcgggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagtcgcggccgcgatatcgctagcgaagttcctattctctagaaagtataggaacttcggatcctctagagtcgaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccgccagtgtccaccgtggacgcggccattcagaccgtggtgcgcggagcccggcgctacgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgagccgctcgaaggctggccgcgggtattgtcactgtgccccccaggtccaggcgacgagcggccgccgcagcagccgcggccattagtgttatgactcagggtcgcaggggcaacgtgtactgggtgcgcgactcggttagcggcctgcgcgtgcccgtgcgcacccgccccccgcgcaactagattgcaataaaaaactacttagactcgtactgttgtatgtatccagcggcggcggcgcgcatcgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgttgcacgcgaccgcgcccaggcgacgggtacagtggaaaggtcgacgcgtaagacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtgacactgcagcaggtgctgcccgcgcttgcaccgtccgaagaaaagcgcggcctaaagcgcgagtctggtgacttggcacccaccgtgcagctgatggtacccaagcgtcagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaagacctctacggaggtgcaaacggacccgtggatgtttcgtgtttcagccccccggcgtccgcgccgttcaaggaagtacggcgccgccagcgcgctactgcccgaatatgccctacatccttccatcgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcgccggtatcctgcccctccttattccactgatcgccgcggcgattggcgccgtgcccggaattgcatccgtggccttgcaggcgcagagacactgattaaaaacaagttacatgtggaaaaatcaaaataaaagtctggactctcacgctcgcttggtcctgtaactattttgtagaatggaagacatcaactttgcgtcactggccccgcgacacggctcgcgcccgttcatgggaaactggcaagatatcggcaccagcaatatgagcggtggcgccttcagctggggctcgctgtggagcggcattaaaaatttcggttccgccgttaagaactatggcagcaaagcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgacccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgtccgccgttgttgtaacccgtcctagccgcgggtccctgcgccgcgccgccagcggtccgcgatcgttgcggcccgtagccagtggcaactggcaaagcacactgaacagcatcgtgggtctgggggtgcaatccctgaagcgccgacgatgcttctgatcgcggccgcgatatcgctagcgaattcgaagttcctattctctagaaagtataggaacttctcgagcacgggatcctctagagtcgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatggacatataaagccgatggtgaaactgccacagaaaaaacccacgtatttgggcaggcgccttattctggtataaatattacaaaagatggtattcaacttggaactgacaccgatgatcagccaatctacgcagataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaagcaaatgtgaaaacaggaacaggcactactaaagaatatgacatagacatgcaatttttcgacaacagaagtgcggctgctgctggcctagctccagaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattagaacagatacttatcagggaattaaggctaatggaactgatcaaaccacatggaccaaagatgacagtgtcaatgatgctaatgaggaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctctctgggaaacgaccttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctatatcccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacttttgactcttctgttagctggccgggcaacgaccgcctgcttactcccaatgagtttgagattaagcgctcagttgacggggagggctataacgtagctcagtgcaacatgacaaaggactggttcctagtgcagatgttggccaactacaatattggctaccagggcttctacattccagaaagctacaaagaccgcatgtactcgttcttcagaaacttccagcccatgagccggcaagtggtggacgatactaaatacaaagattatcagcaggttggaattatccaccagcataacaactcaggcttcgtaggctacctcgctcccaccatgcgcgagggacaagcttaccccgctaatgttccctacccactaataggcaaaaccgcggttgatagtattacccagaaaaagtttctttgcgaccgcaccctgtggcgcatccccttctccagtaactttatgtccatgggtgcgctcacagacctgggccaaaaccttctctacgcaaactccgcccacgcgctagacatgacctttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgcttcccaggctttgtttccccacacaagctcgcctgcgccatagttaacacggccggtcgcgagactgggggcgtacactggatggcctttgcctggaacccgcgctcaaaaacatgctacctctttgagccctttggcttttctgaccaacgtctcaagcaggtttaccagtttgagtacgagtcactcctgcgccgtagcgccattgcctcttcccccgaccgctgtataacgctggaaaagtccacccaaagcgtgcaggggcccaactcggccgcctgtggcctattctgctgcatgtttctccacgcctttgccaactggccccaaactcccatggatcacaaccccaccatgaaccttattaccggggtacccaactccatgcttaacagtccccaggtacagcccaccctgcgccgcaaccaggaacagctctacagcttcctggagcgccactcgccctacttccgcagccacagtgcgcaaattaggagcgccacttctttttgtcacttgaaaaacatgtaaaaataatgtactaggagacactttcaataaaggcaaatgtttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttacagcactggaacactatcagcgccgggtggtgcacgctggccagcacgctcttgtcggagatcanatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccagtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcatccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgagacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaagatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaagcgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctgtgctacacctggcaaacggccatgggcgtgtggcagcagtgcctggaggagcgcaacctgaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttntgcagctagccaactaccttgcctaccactccgacatcatggaagacgtgagcggtgacggcctactggagtgtcactgtcgctgcaacctatgcaccccgcaccgctccctggtctgcaattcacaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccattaacaaagcccgccaagagtttctgctacgaaagggacggggggtttacttggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaggaagcttccgaggccgaagaggtgtcagacgaaacaccgtcaccctcggtcgcattcccctcgccggcgccccagaaatcggcaaccgttcccagcattgctacaacctccgctcctcaggcgccgccggcactgcccgttcgccgacccaaccgtagatgggacaccactggaaccagggccggtaagtctaagcagccgccgccgttagcccaagagcaacaacagcgccaaggctaccgctcgtggcgcgtgcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcaacagcagcggccacgcagaagcaaaggcgaccggatagcaagactctgacaaagcccaagaaatccacagcggcggcagcagcaggaggaggagcactgcgtctggcgcccaacgaacccgtatcgacccgcgagcttagaaacaggatttttcccactctgtatgctatatttcaacagagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtaaaagactcggcggacggctacgactgacagatctgagctcgcggccgcgatatcgctagcgaagttcctattctctagaaagtataggaacttcgatcctctagagtcgacctgcaggcatgcaagcttggcactgcaataaattacttacttaaaatcagtcagcaaatctttgtccagcttattcagcatcacctcctttccctcctcccaactctggtatttcagcagccttttagctgcgaactttctccaaagtctaaatgggatgtcaaattcctcatgttcttgtccctccgcacccactatcttcatattgttgcagatgaaacgcgccagaccgtctgaagacaccttcaaccctgtgtacccatatgacacggaaaccggccctccaactgtgcctttccttacccctccctttgtgtcgccaaatgggttccaagaaagtccccccggagtgctttctttgcgtctttcagaacctttggttacctcacacggcatgcttgcgctaaaaatgggcagcggcctgtccctggatcaggcaggcaaccttacatcaaatacaatcactgtttctcaaccgctaaaaaaaacaaagtccaatataactttggaaacatccgcgccccttacagtcagctcaggcgccctaaccatggccacaacttcgcctttggtggtctctgacaacactcttaccatgcaatcacaagcaccgctaaccgtgcaagactcaaaacttagcattgctaccaaagagccacttacagtgttagatggaaaactggccctgcagacatcagcccccctctctgccactgataacaacgccctcactatcactgcctcacctcctcttactactgcaaatggtagtctggctgttaccatggaaaacccactttacaacaacaatggaaaacttgggctcaaaattggcggtcctttgcaagtggccaccgactcacatgcactaacactaggtactggtcagggggttgcagttcataacaatttgctacatacaaaagttacaggcgcaatagggtttgatacatctggcaacatggaacttaaaactggagatggcctctatgtggatagcgccggtcctaaccaaaaactacatattaatctaaataccacaaaaggccttgcttttgacaacaccgcaataacaattaacgctggaaaagggttggaatttgaaacagactcctcaaacggaaatcccataaaaacaaaaattggatcaggcatacaatataataccaatggagctatggttgcaaaacttggaacaggcctcagttttgacagctccggagccataacaatgggcagcataaacaatgacagacttactctttggacaacaccagacccatccccaaattgcagaattgcttcagataaagactgcaagctaactctggcgctaacaaaatgtggcagtcaaattttgggcactgtttcagctttggcagtatcaggtaatatggcctccatcaatggaactctaagcagtgtaaacttggttcttagatttgatgacaacggagtgcttatgtcaaattcatcactggacaaacagtattggaactttagaaacggggactccactaacggtcaaccatacacttatgctgttgggtttatgccaaacctaaaagcttacccaaaaactcaaagtaaaactgcaaaaagtaatattgttagccaggtgtatcttaatggtgacaagtctaaaccattgcattttactattacgctaaatggaacagatgaaaccaaccaagtaagcaaatactcaatatcattcagttggtcctggaacagtggacaatacactaatgacaaatttgccaccaattcctataccttctcctacattgcccaggaataaagaatcgtgaacctgttgcatgttatgtttcaacgtgtttatttttcaattcgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccaccatgtttgtctttctcgtgctgctgcccctcgtgagcagccagtgcgtcaatctgacaacaaggacccagctgccccccgcctacaccaactccttcacaagaggcgtgtattaccccgataaggtcttcagatccagcgtcctccacagcacccaagatttgtttctgcctttcttcagcaacgtgacatggttccacgccattcatgtcagcggcacaaacggcacaaagaggtttgacaaccccgtgctccccttcaacgacggcgtgtacttcgccagcacagagaaatccaatatcattaggggctggatcttcggcacaacactggattccaagacccagtctctgctcattgtgaataacgccaccaacgtggtgattaaggtctgtgagtttcagttctgcaacgacccctttctgggagtctactaccacaagaataataagagctggatggagtccgagtttagggtgtacagctccgccaacaactgtaccttcgaatacgtgtcccagcctttcctcatggatctggagggcaagcaaggcaatttcaaaaatctgagagagttcgtgttcaaaaacattgatggatacttcaaaatctacagcaagcatacccccattaatctggtgagggatctgccccaaggattctccgctctggaacctctggtggatctgcccattggcattaacatcacaagattccagaccctcctcgccctccatagatcctatctgacccccggcgactcctccagcggatggacagccggagctgccgcctactacgtgggctatctgcagccaagaacctttctgctgaagtacaacgagaacggcaccatcacagacgctgtcgattgcgctctcgaccctctgagcgagaccaaatgcacactgaagagcttcaccgtggaaaagggcatctatcagaccagcaacttcagagtgcagcctaccgagagcattgtgaggtttcccaacatcaccaatctgtgtcctttcggcgaggtctttaatgccacaaggttcgcttccgtgtatgcttggaataggaagaggatcagcaattgcgtcgccgactattccgtcctctataacagcgcctccttctccaccttcaaatgttatggcgtgtcccccaccaagctcaacgacctctgcttcaccaatgtgtacgctgactccttcgtcattaggggcgacgaggtgaggcaaattgcccccggccagaccggcaagattgctgattacaactacaaactgcccgacgattttaccggctgcgtgatcgcttggaactccaacaatctggactccaaagtgggcggaaactacaattacctctacagactctttagaaaaagcaatctgaagcccttcgagagagacatctccaccgaaatctaccaagccggaagcacaccttgcaatggcgtcgagggatttaactgctacttccctctgcagagctacggctttcaacctaccaacggcgtcggatatcaaccctatagggtggtcgtgctgagctttgaactgctgcatgctcccgccaccgtctgcggacctaagaagagcaccaatctcgtcaaaaacaagtgcgtgaacttcaacttcaatggactgaccggcaccggcgtgctgaccgagagcaataagaagtttctgcccttccagcagttcggaagggatattgccgataccacagatgctgtgagggacccccaaaccctcgagattctggatatcaccccttgcagcttcggaggagtgtccgtgatcacccccggaacaaacacctccaatcaagtggctgtgctgtaccaagacgtgaactgcacagaagtccccgtggccatccatgccgaccagctgacccctacatggagagtgtactccaccggcagcaatgtgttccagacaagagccggatgcctcattggagctgaacacgtcaacaacagctacgagtgcgacattcccatcggcgccggcatttgtgcctcctatcagacccagaccaacagcccaagaagggctagaagcgtcgcttcccaatccatcattgcctacaccatgtctctgggagccgaaaactccgtcgcctactccaacaatagcatcgccatccccaccaattttaccatctccgtgaccacagagattctgcccgtgtccatgacaaagacatccgtggactgcaccatgtacatctgtggcgacagcaccgagtgtagcaatctgctgctgcaatatggcagcttctgcacccagctgaacagagccctcaccggcatcgccgtcgaacaagacaagaacacccaagaggtgttcgcccaagtgaagcaaatctacaagaccccccctatcaaagatttcggaggattcaactttagccagattctgcccgatcctagcaagccttccaagaggagcttcatcgaggatctgctgtttaataaggtgacactggccgacgctggcttcattaaacagtacggcgattgtctgggcgacatcgctgctagggatctgatctgcgctcagaagttcaacggactgacagtcctccctcctctgctgaccgacgagatgatcgctcagtataccagcgctctgctggctggaaccattaccagcggctggacattcggcgctggagccgccctccaaattccctttgccatgcagatggcctatagattcaacggcattggcgtcacccaaaatgtgctgtatgaaaatcagaagctgattgctaaccaattcaatagcgccattggcaagatccaagactctctgagctccacagccagcgccctcggaaagctgcaagacgtggtgaatcaaaacgcccaagctctgaacacactggtgaaacagctcagcagcaactttggagccatcagcagcgtgctcaatgatatcctctctaggctggaccctccggaggccgaagtccagatcgatagactcatcaccggcagactccaatctctgcagacatacgtcacccaacagctcattagagctgccgaaatcagagcctccgccaatctggccgccaccaagatgtccgagtgcgtgctgggacagagcaagagagtggacttctgtggcaagggataccatctgatgagcttcccccagagcgctccccatggagtggtctttctgcatgtcacatacgtgcccgcccaagagaagaacttcaccaccgctcccgccatttgccacgatggaaaggcccactttcccagagaaggagtgttcgtgagcaacggcacacactggtttgtcacccagagaaatttttacgagccccagattatcaccaccgacaacaccttcgtgtccggaaactgcgatgtcgtgattggcatcgtgaacaacacagtctacgaccctctgcagcccgaactcgacagcttcaaggaagagctggacaagtacttcaagaatcacacatcccccgacgtggatctgggcgacattagcggcattaatgcctccgtcgtcaacattcagaaggagattgatagactgaatgaagtcgccaagaacctcaatgagtctctgattgatctgcaagagctgggcaagtacgagcaatacatcaaatggccttggtacatctggctgggattcatcgctggactcatcgccatcgtgatggtcaccattatgctgtgttgcatgaccagctgctgcagctgtctgaagggctgctgcagctgcggaagctgctgcaagtttgacgaagacgactccgagcccgtgctgaagggcgtcaagctgcattatacataaactagtgctggaattcgcccttatagagtgctggaattcgcccttatagagtgctggaattcgcccttatatctagtaacggccgccagtgtgctggaattcgcccttataacttcgtatagcatacattatacgaagttataagggcgaattctgcagatatccatcctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacaacgtgtttatttttcaattgcagaaagaattgcagaaaatttcaagtcatttttcattcagtagtatagccccaccaccacatagcttatactaatcaccgtaccttaatcaaactcacagaaccctagtattcaacctgccacctccctcccaacacacagagtacacagtcctttctccccggctggccttaaacagcatcatatcatgggtaacagacatattcttaggtgttatattccacacggtctcctgtcgagccaaacgctcatcagtgatgttaataaactccccgggcagctcgcttaagttcatgtcgctgtccagctgctgagccacaggctgctgtccaacttgcggttgctcaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaagtcagcacagtaactgcagcacagtaccacaatattgtttaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgtgtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcanggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtactgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcataaacacaaaataaaataacaaaaaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacccctgaaaaaccctcctgcccctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaccacccagaaaaccgcacgcgaacctacgcccagaaacgaaagccaaaaaacccacaacttcctcaaatcttcacttccgttttcccacgatacgtcacttcccattttaaaaaaaaactacaattcccaatacatgcaagttactccgccctaaaacctacgtcacccgccccgttcccacgccccgcgccacgtcacaaactccaccccctcattatcatattggcttcaatccaaaataaggtatattattgatgatggcgat

What is claimed is:

1. A single-cycle adenovirus (SC-Ad), wherein said SC-Ad comprises a genome lacking at least a portion of a nucleic acid sequence that encodes an adenovirus polypeptide, wherein said SC-Ad comprises said adenovirus polypeptide, and wherein said SC-Ad comprises a nucleic acid sequence encoding a coronavirus immunogen.

2. The SC-Ad of claim 1, wherein said adenovirus polypeptide is selected from the group consisting of a fiber polypeptide, a V polypeptide, a hexon polypeptide, a penton base polypeptide, and a pIIIa polypeptide.

3. The SC-Ad of claim 1, wherein said coronavirus immunogen comprises a coronavirus Spike polypeptide or an immunogenic fragment thereof.

4. The SC-Ad of claim 3, wherein said coronavirus immunogen consists of or consists essentially of an amino acid sequence set forth in any one of SEQ ID NOs:1-4.

5. The SC-Ad of claim 1, wherein said SC-Ad further comprises a nucleic acid sequence encoding an adjuvant polypeptide.

6. The SC-Ad of claim 5, wherein said adjuvant polypeptide is selected from the group consisting of a granulocyte-macrophage colony-stimulating factor (GM-CSF) polypeptide, an interleukin 4 (IL-4) polypeptide, an interleukin 21 (IL-21) polypeptide, a CD40 ligand (CD40L) polypeptide, a 4-1BB ligand (4-1BBL) polypeptide, a transforming growth factor beta (TGF-β) polypeptide, a *Clostridium difficile* TcdA polypeptide, a *C. difficile* TcdB polypeptide, and biologically active fragments thereof.

7. The SC-Ad of claim 5, wherein said coronavirus Spike polypeptide is fused to said adjuvant polypeptide.

8. The SC-Ad of claim 7, wherein said coronavirus Spike polypeptide fused to said adjuvant polypeptide consists essentially of or consists of an amino acid sequence set forth in SEQ ID NO:5.

9. The SC-Ad of claim 1, wherein said SC-Ad further comprises a nucleic acid sequence encoding a chaff polypeptide.

10. The SC-Ad of claim 9, wherein said chaff polypeptide is a fragment of an ACE2 polypeptide.

11. The SC-Ad of claim 10, wherein said fragment of an ACE2 polypeptide comprises the extracellular region of an ACE2 polypeptide and lacks a transmembrane domain.

12. The SC-Ad of claim 11, wherein said chaff polypeptide consists essentially of or consists of an amino acid sequence set forth in SEQ ID NO:8 or SEQ ID NO:9.

13. The SC-Ad of claim 9, wherein said coronavirus Spike polypeptide is fused to said chaff polypeptide.

14. A composition comprising a single-cycle adenovirus (SC-Ad), wherein said SC-Ad comprises a genome lacking at least a portion of a nucleic acid sequence that encodes an adenovirus polypeptide, wherein said SC-Ad comprises said adenovirus polypeptide, and wherein said SC-Ad comprises a nucleic acid sequence encoding a coronavirus immunogen.

15. A method for inducing an immune response against a coronavirus in a mammal, wherein said method comprises administering a single-cycle adenovirus (SC-Ad) to said mammal under conditions wherein said SC-Ad infects a cell of said mammal, and wherein expression of said immunogen in said cell leads to induction of said immune response.

16. The method of claim 15, wherein said mammal is a human.

17. The method of claim 15, wherein said coronavirus is a betacoronavirus.

18. The method of claim 17, wherein said betacoronavirus is SARS-CoV-2.

19. The method of claim 15, wherein said administering comprising mucosal delivery of said SC-Ad.

* * * * *